United States Patent 12,102,091 (CONTROL OF PLANT PESTS USING RNA MOLECULES) - sequence listing, part 4

SEQ ID NO: 7753 - DNA, 20 bp, Artificial Sequence
  Synthetic polynucleotide
aaagttgttttggccacaaa

SEQ ID NO: 7754 - DNA, 20 bp, Artificial Sequence
  Synthetic polynucleotide
ttcgtaacaccattgtaggg

SEQ ID NO: 7755 - DNA, 20 bp, Artificial Sequence
  Synthetic polynucleotide
tggagaattttcgaagagca

SEQ ID NO: 7756 - DNA, 20 bp, Artificial Sequence
  Synthetic polynucleotide
catcgtccgttcctctaatt

SEQ ID NO: 7757 - DNA, 20 bp, Artificial Sequence
  Synthetic polynucleotide
gaagggctagggatgaaaaa

SEQ ID NO: 7758 - DNA, 20 bp, Artificial Sequence
  Synthetic polynucleotide
ccggcatttatttttccctc

SEQ ID NO: 7759 - DNA, 20 bp, Artificial Sequence
  Synthetic polynucleotide
ttgtagtcgtcgaaactgtt

SEQ ID NO: 7760 - DNA, 20 bp, Artificial Sequence
  Synthetic polynucleotide
ttcgccaatcttcttaccaa

SEQ ID NO: 7761 - DNA, 20 bp, Artificial Sequence
  Synthetic polynucleotide
gtgttcttcttggttgttgg

SEQ ID NO: 7762 - DNA, 20 bp, Artificial Sequence
  Synthetic polynucleotide
aagctgccagataaacaact

SEQ ID NO: 7763 - DNA, 20 bp, Artificial Sequence
  Synthetic polynucleotide
caaatcgcggatgtgataag

SEQ ID NO: 7764 - DNA, 20 bp, Artificial Sequence
  Synthetic polynucleotide
acatttgtctgagattcccc

SEQ ID NO: 7765 - DNA, 20 bp, Artificial Sequence
  Synthetic polynucleotide
aatccttatgccgacaatgg

SEQ ID NO: 7766 - DNA, 20 bp, Artificial Sequence
  Synthetic polynucleotide
atctctttcagcagcagaaa

SEQ ID NO: 7767 - DNA, 20 bp, Artificial Sequence
  Synthetic polynucleotide
gctactcagtggctatgttt

SEQ ID NO: 7768 - DNA, 20 bp, Artificial Sequence
  Synthetic polynucleotide
actatcagctccggaagtat

SEQ ID NO: 7769 - DNA, 20 bp, Artificial Sequence
  Synthetic polynucleotide
aggaaaggttggtggaaaat

SEQ ID NO: 7770 - DNA, 20 bp, Artificial Sequence
  Synthetic polynucleotide
gttccaaggaagctagttga

SEQ ID NO: 7771 - DNA, 22 bp, Artificial Sequence
  Synthetic polynucleotide
tcaaaaggagaaaagaaacgtt

SEQ ID NO: 7772 - DNA, 20 bp, Artificial Sequence
  Synthetic polynucleotide
aacgcatgattacaaacacc

SEQ ID NO: 7773 - DNA, 20 bp, Artificial Sequence
  Synthetic polynucleotide
ggttggagaaaagcagtaga

SEQ ID NO: 7774 - DNA, 20 bp, Artificial Sequence
  Synthetic polynucleotide
atcatgaatggatcggtcag

SEQ ID NO: 7775 - DNA, 20 bp, Artificial Sequence
  Synthetic polynucleotide
gcatcaggtagaatatgcca

SEQ ID NO: 7776 - DNA, 20 bp, Artificial Sequence
  Synthetic polynucleotide
tcttctaaagcactggatgg

SEQ ID NO: 7777 - DNA, 20 bp, Artificial Sequence
  Synthetic polynucleotide
ggactttgccaaattctacg

SEQ ID NO: 7778 - DNA, 20 bp, Artificial Sequence
  Synthetic polynucleotide
tcctctggaagtaactcgat

SEQ ID NO: 7779 - DNA, 20 bp, Artificial Sequence
  Synthetic polynucleotide
ctattgtgggagctctttgt

SEQ ID NO: 7780 - DNA, 20 bp, Artificial Sequence
  Synthetic polynucleotide
agtttgaaagtgttggaggt

SEQ ID NO: 7781 - DNA, 20 bp, Artificial Sequence
  Synthetic polynucleotide
gcacccaaacttcgttattt

SEQ ID NO: 7782 - DNA, 20 bp, Artificial Sequence
  Synthetic polynucleotide
aagaccaactttacgaccag

SEQ ID NO: 7783 - DNA, 20 bp, Artificial Sequence
  Synthetic polynucleotide
aaacagttagcaaccaaagc

SEQ ID NO: 7784 - DNA, 20 bp, Artificial Sequence
  Synthetic polynucleotide
gcgtgaatagcgcataaatt

SEQ ID NO: 7785 - DNA, 20 bp, Artificial Sequence
  Synthetic polynucleotide
caagatgatatgactggcga

SEQ ID NO: 7786 - DNA, 20 bp, Artificial Sequence
  Synthetic polynucleotide
tccttctttggcaagcatat

SEQ ID NO: 7787 - DNA, 20 bp, Artificial Sequence
  Synthetic polynucleotide
aacgtccaacaaccaaaatc

SEQ ID NO: 7788 - DNA, 20 bp, Artificial Sequence
  Synthetic polynucleotide
ctggcctgtactggttaatt

SEQ ID NO: 7789 - DNA, 23 bp, Artificial Sequence
  Synthetic polynucleotide
tgaatgtgataaaatgttggagt

SEQ ID NO: 7790 - DNA, 20 bp, Artificial Sequence
  Synthetic polynucleotide
aatattttggcatccccctc

SEQ ID NO: 7791 - DNA, 20 bp, Artificial Sequence
  Synthetic polynucleotide
tctatcattcaagggttgcc

SEQ ID NO: 7792 - DNA, 20 bp, Artificial Sequence
  Synthetic polynucleotide
ttctgcatcttcagctgaat

SEQ ID NO: 7793 - DNA, 20 bp, Artificial Sequence
  Synthetic polynucleotide
gatcaatgagggaaaaccct

SEQ ID NO: 7794 - DNA, 20 bp, Artificial Sequence
  Synthetic polynucleotide
atactgttgtacggcctttt

SEQ ID NO: 7795 - DNA, 20 bp, Artificial Sequence
  Synthetic polynucleotide
tctccgtaagaagaggaagt

SEQ ID NO: 7796 - DNA, 20 bp, Artificial Sequence
  Synthetic polynucleotide
atcagctctaccacattgtc

SEQ ID NO: 7797 - DNA, 20 bp, Artificial Sequence
  Synthetic polynucleotide
ggatactgccgaacaagtat

SEQ ID NO: 7798 - DNA, 20 bp, Artificial Sequence
  Synthetic polynucleotide
tagcaagttgttctggagtc

SEQ ID NO: 7799 - DNA, 20 bp, Artificial Sequence
  Synthetic polynucleotide
ccttgatgatggtggagaaa

SEQ ID NO: 7800 - DNA, 20 bp, Artificial Sequence
  Synthetic polynucleotide
tggcatcaactcagctattt

SEQ ID NO: 7801 - DNA, 20 bp, Artificial Sequence
  Synthetic polynucleotide
atctggtttcgagcttcaaa

SEQ ID NO: 7802 - DNA, 20 bp, Artificial Sequence
  Synthetic polynucleotide
atgcttaaaccttccgactt

SEQ ID NO: 7803 - DNA, 21 bp, Artificial Sequence
  Synthetic polynucleotide
cgaaggaagattgtttcaagt

SEQ ID NO: 7804 - DNA, 22 bp, Artificial Sequence
  Synthetic polynucleotide
ggagtcatagtcataacctcaa

SEQ ID NO: 7805 - DNA, 20 bp, Artificial Sequence
  Synthetic polynucleotide
ataaaggccgtcaatgtctt

SEQ ID NO: 7806 - DNA, 20 bp, Artificial Sequence
  Synthetic polynucleotide
aattgttccctggagcttag

SEQ ID NO: 7807 - DNA, 21 bp, Artificial Sequence
  Synthetic polynucleotide
tcagcaaattcaacaatgact

SEQ ID NO: 7808 - DNA, 20 bp, Artificial Sequence
  Synthetic polynucleotide
aacacttccatgcatttgtg

SEQ ID NO: 7809 - DNA, 20 bp, Artificial Sequence
  Synthetic polynucleotide
tttagaagacactcagcacc

SEQ ID NO: 7810 - DNA, 20 bp, Artificial Sequence
  Synthetic polynucleotide
aaagagcttcttcgaagtgt

SEQ ID NO: 7811 - DNA, 20 bp, Artificial Sequence
  Synthetic polynucleotide
tggattgttacccaaggatg

SEQ ID NO: 7812 - DNA, 20 bp, Artificial Sequence
  Synthetic polynucleotide
attgtttgaggtccagatcc

SEQ ID NO: 7813 - DNA, 20 bp, Artificial Sequence
  Synthetic polynucleotide
tagctggacaagaaagtgac

SEQ ID NO: 7814 - DNA, 20 bp, Artificial Sequence
  Synthetic polynucleotide
aagaatggacactgatccac

SEQ ID NO: 7815 - DNA, 20 bp, Artificial Sequence
  Synthetic polynucleotide
aacttataaaggccaccagg

SEQ ID NO: 7816 - DNA, 20 bp, Artificial Sequence
  Synthetic polynucleotide
tgcaactgatttcatagcct

SEQ ID NO: 7817 - DNA, 20 bp, Artificial Sequence
  Synthetic polynucleotide
gaccgtttggctggatatat

SEQ ID NO: 7818 - DNA, 20 bp, Artificial Sequence
  Synthetic polynucleotide
cattagccgattgcaagttt

SEQ ID NO: 7819 - DNA, 20 bp, Artificial Sequence
  Synthetic polynucleotide
gagagccgttgaattcaaag

SEQ ID NO: 7820 - DNA, 20 bp, Artificial Sequence
  Synthetic polynucleotide
gttgcatcgggtattcctat

SEQ ID NO: 7821 - DNA, 20 bp, Artificial Sequence
  Synthetic polynucleotide
agttcccagtctatgtgaag

SEQ ID NO: 7822 - DNA, 19 bp, Artificial Sequence
  Synthetic polynucleotide
gttgaactgatcgcagact

SEQ ID NO: 7823 - DNA, 20 bp, Artificial Sequence
  Synthetic polynucleotide
taaagccaacaacaaagctg

SEQ ID NO: 7824 - DNA, 20 bp, Artificial Sequence
  Synthetic polynucleotide
ggcggtacttttatagtcgt

SEQ ID NO: 7825 - DNA, 20 bp, Artificial Sequence
  Synthetic polynucleotide
atgagcaaaggacatgtcat

SEQ ID NO: 7826 - DNA, 20 bp, Artificial Sequence
  Synthetic polynucleotide
ctggatctaatcacgacgtt

SEQ ID NO: 7827 - DNA, 20 bp, Artificial Sequence
  Synthetic polynucleotide
ggcgttccataacatatcct

SEQ ID NO: 7828 - DNA, 20 bp, Artificial Sequence
  Synthetic polynucleotide
tggggataatgtggagtttg

SEQ ID NO: 7829 - DNA, 20 bp, Artificial Sequence
  Synthetic polynucleotide
ttaaggatcatgctgctgtt

SEQ ID NO: 7830 - DNA, 20 bp, Artificial Sequence
  Synthetic polynucleotide
ataagcctgtagggtctcat

SEQ ID NO: 7831 - DNA, 20 bp, Artificial Sequence
  Synthetic polynucleotide
ttgaacctccaagacagatg

SEQ ID NO: 7832 - DNA, 20 bp, Artificial Sequence
  Synthetic polynucleotide
ataggccttcatacagtcct

SEQ ID NO: 7833 - DNA, 20 bp, Artificial Sequence
  Synthetic polynucleotide
aaagataggtgctctgcaaa

SEQ ID NO: 7834 - DNA, 20 bp, Artificial Sequence
  Synthetic polynucleotide
atgtgatcatacaccactcg

SEQ ID NO: 7835 - DNA, 20 bp, Artificial Sequence
  Synthetic polynucleotide
ttggtcagaaactaacaggg

SEQ ID NO: 7836 - DNA, 20 bp, Artificial Sequence
  Synthetic polynucleotide
ggattgaacattggtggtct

SEQ ID NO: 7837 - DNA, 20 bp, Artificial Sequence
  Synthetic polynucleotide
aacaattaccggcgaagtat

SEQ ID NO: 7838 - DNA, 19 bp, Artificial Sequence
  Synthetic polynucleotide
cctcgtactggttgtgttt

SEQ ID NO: 7839 - DNA, 20 bp, Artificial Sequence
  Synthetic polynucleotide
tcaacaagttggtgcaaatc

SEQ ID NO: 7840 - DNA, 20 bp, Artificial Sequence
  Synthetic polynucleotide
taacagctgattgaactgct

SEQ ID NO: 7841 - DNA, 21 bp, Artificial Sequence
  Synthetic polynucleotide
tgatctgcaagaaaagattgg

SEQ ID NO: 7842 - DNA, 22 bp, Artificial Sequence
  Synthetic polynucleotide
aggatgaggtaattatgggatc

SEQ ID NO: 7843 - DNA, 20 bp, Artificial Sequence
  Synthetic polynucleotide
gtggtcagaagattcccatt

SEQ ID NO: 7844 - DNA, 20 bp, Artificial Sequence
  Synthetic polynucleotide
tggtgttagagcttcttcac

SEQ ID NO: 7845 - DNA, 20 bp, Artificial Sequence
  Synthetic polynucleotide
ggaacaacctggagatgtta

SEQ ID NO: 7846 - DNA, 19 bp, Artificial Sequence
  Synthetic polynucleotide
gcctatccatagcccaaag

SEQ ID NO: 7847 - DNA, 20 bp, Artificial Sequence
  Synthetic polynucleotide
accactcttcacaacctttt

SEQ ID NO: 7848 - DNA, 20 bp, Artificial Sequence
  Synthetic polynucleotide
gccatttctgattccacatg

SEQ ID NO: 7849 - DNA, 20 bp, Artificial Sequence
  Synthetic polynucleotide
taagcataaaaagcgaaggc

SEQ ID NO: 7850 - DNA, 20 bp, Artificial Sequence
  Synthetic polynucleotide
caggtacatgtgctacgaat

SEQ ID NO: 7851 - DNA, 20 bp, Artificial Sequence
  Synthetic polynucleotide
accggtaaaactacctttgt

SEQ ID NO: 7852 - DNA, 20 bp, Artificial Sequence
  Synthetic polynucleotide
catttggacttctggaggaa

SEQ ID NO: 7853 - DNA, 20 bp, Artificial Sequence
  Synthetic polynucleotide
atagcttcgctacttcacag

SEQ ID NO: 7854 - DNA, 20 bp, Artificial Sequence
  Synthetic polynucleotide
ttgtaacatcgcttgaggaa

SEQ ID NO: 7855 - DNA, 20 bp, Artificial Sequence
  Synthetic polynucleotide
aaatggtatgtggctcatcc

SEQ ID NO: 7856 - DNA, 20 bp, Artificial Sequence
  Synthetic polynucleotide
cttgtttcctgaacttcacc

SEQ ID NO: 7857 - DNA, 20 bp, Artificial Sequence
  Synthetic polynucleotide
gaaattcctttattggccgg

SEQ ID NO: 7858 - DNA, 20 bp, Artificial Sequence
  Synthetic polynucleotide
aaaccacccatgatatcacc

SEQ ID NO: 7859 - DNA, 20 bp, Artificial Sequence
  Synthetic polynucleotide
acctggcttaaatactgtgg

SEQ ID NO: 7860 - DNA, 20 bp, Artificial Sequence
  Synthetic polynucleotide
atctgcagcactatctcttg

SEQ ID NO: 7861 - DNA, 20 bp, Artificial Sequence
  Synthetic polynucleotide
agatcgagagacaggagaaa

SEQ ID NO: 7862 - DNA, 20 bp, Artificial Sequence
  Synthetic polynucleotide
catccttgggtaacaatcca

SEQ ID NO: 7863 - DNA, 20 bp, Artificial Sequence
  Synthetic polynucleotide
gatccttgggttatgcgtat

SEQ ID NO: 7864 - DNA, 20 bp, Artificial Sequence
  Synthetic polynucleotide
cttttgggctcttcctacat

SEQ ID NO: 7865 - DNA, 20 bp, Artificial Sequence
  Synthetic polynucleotide
gtaggcaaagatgtttcagc

SEQ ID NO: 7866 - DNA, 20 bp, Artificial Sequence
  Synthetic polynucleotide
agtatctccagccagaatct

SEQ ID NO: 7867 - DNA, 20 bp, Artificial Sequence
  Synthetic polynucleotide
gaagtgggagctacttcttc

SEQ ID NO: 7868 - DNA, 20 bp, Artificial Sequence
  Synthetic polynucleotide
ttgggctgttcctaaaactt

SEQ ID NO: 7869 - DNA, 20 bp, Artificial Sequence
  Synthetic polynucleotide
tggaagaggaattgacagtg

SEQ ID NO: 7870 - DNA, 20 bp, Artificial Sequence
  Synthetic polynucleotide
cttacccatcttccaacaca

SEQ ID NO: 7871 - DNA, 20 bp, Artificial Sequence
  Synthetic polynucleotide
ttttaaaagaaggcgctagc

SEQ ID NO: 7872 - DNA, 20 bp, Artificial Sequence
  Synthetic polynucleotide
atccatttttgtcctggtga

SEQ ID NO: 7873 - DNA, 20 bp, Artificial Sequence
  Synthetic polynucleotide
ctgtgggatgtgaaacacta

SEQ ID NO: 7874 - DNA, 20 bp, Artificial Sequence
  Synthetic polynucleotide
taagtggctgaagttcttcc

SEQ ID NO: 7875 - DNA, 20 bp, Artificial Sequence
  Synthetic polynucleotide
ctttcttttcctcagcagct

SEQ ID NO: 7876 - DNA, 20 bp, Artificial Sequence
  Synthetic polynucleotide
tagggtctgtaggtgttgaa

SEQ ID NO: 7877 - DNA, 20 bp, Artificial Sequence
  Synthetic polynucleotide
tccacaacttcgtgatgatt

SEQ ID NO: 7878 - DNA, 20 bp, Artificial Sequence
  Synthetic polynucleotide
ctgagcagcagcatatctaa

SEQ ID NO: 7879 - DNA, 20 bp, Artificial Sequence
  Synthetic polynucleotide
tactttgccatcgaatccaa

SEQ ID NO: 7880 - DNA, 20 bp, Artificial Sequence
  Synthetic polynucleotide
atggtccatttgttgatcga

SEQ ID NO: 7881 - DNA, 20 bp, Artificial Sequence
  Synthetic polynucleotide
aggactggataatgcaggta

SEQ ID NO: 7882 - DNA, 20 bp, Artificial Sequence
  Synthetic polynucleotide
tagttctagaggcctaccag

SEQ ID NO: 7883 - DNA, 20 bp, Artificial Sequence
  Synthetic polynucleotide
atcccactactattgccaac

SEQ ID NO: 7884 - DNA, 22 bp, Artificial Sequence
  Synthetic polynucleotide
tctagttgggagaacaatactt

SEQ ID NO: 7885 - DNA, 20 bp, Artificial Sequence
  Synthetic polynucleotide
attgtcgtatccttcagctc

SEQ ID NO: 7886 - DNA, 20 bp, Artificial Sequence
  Synthetic polynucleotide
gattcggttgagtattccga

SEQ ID NO: 7887 - DNA, 20 bp, Artificial Sequence
  Synthetic polynucleotide
ccgcaagactcaaaaagatc

SEQ ID NO: 7888 - DNA, 20 bp, Artificial Sequence
  Synthetic polynucleotide
aagccttgtgttactaggtg

SEQ ID NO: 7889 - DNA, 20 bp, Artificial Sequence
  Synthetic polynucleotide
gaaagatgatatggccccat

SEQ ID NO: 7890 - DNA, 20 bp, Artificial Sequence
  Synthetic polynucleotide
aattcggcatactgacagtt

SEQ ID NO: 7891 - DNA, 20 bp, Artificial Sequence
  Synthetic polynucleotide
cgcagcaacaacagaatatt

SEQ ID NO: 7892 - DNA, 20 bp, Artificial Sequence
  Synthetic polynucleotide
accctaatagtaccaggacc

SEQ ID NO: 7893 - DNA, 20 bp, Artificial Sequence
  Synthetic polynucleotide
tcagacgttgccttttgata

SEQ ID NO: 7894 - DNA, 20 bp, Artificial Sequence
  Synthetic polynucleotide
tgatgctggggtatagagaa

SEQ ID NO: 7895 - DNA, 20 bp, Artificial Sequence
  Synthetic polynucleotide
ccatacttcagaaccaccaa

SEQ ID NO: 7896 - DNA, 20 bp, Artificial Sequence
  Synthetic polynucleotide
cggcatctgttaaagtttcc

SEQ ID NO: 7897 - DNA, 20 bp, Artificial Sequence
  Synthetic polynucleotide
ctagagctgtacatgtgtcc

SEQ ID NO: 7898 - DNA, 20 bp, Artificial Sequence
  Synthetic polynucleotide
acagaaagcttatcaaccgt

SEQ ID NO: 7899 - DNA, 20 bp, Artificial Sequence
  Synthetic polynucleotide
ttgtgcttcctacaaatcga

SEQ ID NO: 7900 - DNA, 20 bp, Artificial Sequence
  Synthetic polynucleotide
catcaggtgcacgtagatta

SEQ ID NO: 7901 - DNA, 20 bp, Artificial Sequence
  Synthetic polynucleotide
ggaagcttttactacaacgc

SEQ ID NO: 7902 - DNA, 20 bp, Artificial Sequence
  Synthetic polynucleotide
gtcttactggaggagagtct

SEQ ID NO: 7903 - DNA, 20 bp, Artificial Sequence
  Synthetic polynucleotide
cttgaacccatttcagttcg

SEQ ID NO: 7904 - DNA, 20 bp, Artificial Sequence
  Synthetic polynucleotide
ctgatgctccattttggtct

SEQ ID NO: 7905 - DNA, 20 bp, Artificial Sequence
  Synthetic polynucleotide
cttaccaaatgcccttcaac

SEQ ID NO: 7906 - DNA, 20 bp, Artificial Sequence
  Synthetic polynucleotide
gcccttcaagtcttataggg

SEQ ID NO: 7907 - DNA, 20 bp, Artificial Sequence
  Synthetic polynucleotide
gacctatgcagaccaaatga

SEQ ID NO: 7908 - DNA, 20 bp, Artificial Sequence
  Synthetic polynucleotide
cagatgataactggctctgg

SEQ ID NO: 7909 - DNA, 20 bp, Artificial Sequence
  Synthetic polynucleotide
atatcatcctcagggaccaa

SEQ ID NO: 7910 - DNA, 20 bp, Artificial Sequence
  Synthetic polynucleotide
taataggtcctttccgtcct

SEQ ID NO: 7911 - DNA, 20 bp, Artificial Sequence
  Synthetic polynucleotide
ataaaaagcatagcgatcgc

SEQ ID NO: 7912 - DNA, 20 bp, Artificial Sequence
  Synthetic polynucleotide
tgagcttttattttgcctgc

SEQ ID NO: 7913 - DNA, 20 bp, Artificial Sequence
  Synthetic polynucleotide
atatggttgctctttgctca

SEQ ID NO: 7914 - DNA, 20 bp, Artificial Sequence
  Synthetic polynucleotide
gctgcaagaagtttcaagtt

SEQ ID NO: 7915 - DNA, 20 bp, Artificial Sequence
  Synthetic polynucleotide
tcatcatccaactgttcgtt

SEQ ID NO: 7916 - DNA, 20 bp, Artificial Sequence
  Synthetic polynucleotide
acatgaagacgatgtagagc

SEQ ID NO: 7917 - DNA, 20 bp, Artificial Sequence
  Synthetic polynucleotide
cgaccacattatacgttgga

SEQ ID NO: 7918 - DNA, 19 bp, Artificial Sequence
  Synthetic polynucleotide
cataccctcctcttccaga

SEQ ID NO: 7919 - DNA, 20 bp, Artificial Sequence
  Synthetic polynucleotide
aaacttatcctctgttggcc

SEQ ID NO: 7920 - DNA, 19 bp, Artificial Sequence
  Synthetic polynucleotide
cgcaatagcccgttaaaag

SEQ ID NO: 7921 - DNA, 20 bp, Artificial Sequence
  Synthetic polynucleotide
acacctcctgaaaagtgttt

SEQ ID NO: 7922 - DNA, 20 bp, Artificial Sequence
  Synthetic polynucleotide
tttaaaacgattcatggcgg

SEQ ID NO: 7923 - DNA, 20 bp, Artificial Sequence
  Synthetic polynucleotide
ccactttttgaaaagaggcc

SEQ ID NO: 7924 - DNA, 20 bp, Artificial Sequence
  Synthetic polynucleotide
caatacgagcagcagatttg

SEQ ID NO: 7925 - DNA, 20 bp, Artificial Sequence
  Synthetic polynucleotide
gatccagaaagtggtggaat

SEQ ID NO: 7926 - DNA, 20 bp, Artificial Sequence
  Synthetic polynucleotide
ggcatgcagtaagtaggatt

SEQ ID NO: 7927 - DNA, 20 bp, Artificial Sequence
  Synthetic polynucleotide
ggaaaatcacataagcagcc

SEQ ID NO: 7928 - DNA, 20 bp, Artificial Sequence
  Synthetic polynucleotide
ggaatgtggggttcaagtat

SEQ ID NO: 7929 - DNA, 20 bp, Artificial Sequence
  Synthetic polynucleotide
atgtcagtggaatttgacga

SEQ ID NO: 7930 - DNA, 20 bp, Artificial Sequence
  Synthetic polynucleotide
cccactctgctaatctgtac

SEQ ID NO: 7931 - DNA, 20 bp, Artificial Sequence
  Synthetic polynucleotide
ctgcaagactctcgtacttt

SEQ ID NO: 7932 - DNA, 18 bp, Artificial Sequence
  Synthetic polynucleotide
acgtcccattcccatttg

SEQ ID NO: 7933 - DNA, 20 bp, Artificial Sequence
  Synthetic polynucleotide
tttggcaagtggatgttcta

SEQ ID NO: 7934 - DNA, 20 bp, Artificial Sequence
  Synthetic polynucleotide
gattagttagcggtgctgta

SEQ ID NO: 7935 - DNA, 20 bp, Artificial Sequence
  Synthetic polynucleotide
atagactgtcgccgatagta

SEQ ID NO: 7936 - DNA, 20 bp, Artificial Sequence
  Synthetic polynucleotide
caaatggttccatcatctgc

SEQ ID NO: 7937 - DNA, 20 bp, Artificial Sequence
  Synthetic polynucleotide
tacatcagtcagtagctgga

SEQ ID NO: 7938 - DNA, 20 bp, Artificial Sequence
  Synthetic polynucleotide
cctaggacggtatttgtcag

SEQ ID NO: 7939 - DNA, 20 bp, Artificial Sequence
  Synthetic polynucleotide
caaggcagatgcttttacag

SEQ ID NO: 7940 - DNA, 20 bp, Artificial Sequence
  Synthetic polynucleotide
aggtggaagcatagagatct

SEQ ID NO: 7941 - DNA, 20 bp, Artificial Sequence
  Synthetic polynucleotide
cgagagcagctaaaagatct

SEQ ID NO: 7942 - DNA, 20 bp, Artificial Sequence
  Synthetic polynucleotide
gctgaagtaccctcagaaaa

SEQ ID NO: 7943 - DNA, 20 bp, Artificial Sequence
  Synthetic polynucleotide
ggctatttctcatgcaggta

SEQ ID NO: 7944 - DNA, 20 bp, Artificial Sequence
  Synthetic polynucleotide
agttcttctacttccttgcc

SEQ ID NO: 7945 - DNA, 20 bp, Artificial Sequence
  Synthetic polynucleotide
tgtgtaccctatgtagcaga

SEQ ID NO: 7946 - DNA, 20 bp, Artificial Sequence
  Synthetic polynucleotide
aaccaacatacgctaaacct

SEQ ID NO: 7947 - DNA, 20 bp, Artificial Sequence
  Synthetic polynucleotide
ctcgaacaagcagcatttag

SEQ ID NO: 7948 - DNA, 20 bp, Artificial Sequence
  Synthetic polynucleotide
atgatggtgatacgaagctg

SEQ ID NO: 7949 - DNA, 20 bp, Artificial Sequence
  Synthetic polynucleotide
ttcataccaacactgactgg

SEQ ID NO: 7950 - DNA, 20 bp, Artificial Sequence
  Synthetic polynucleotide
tcgcgtatgtaaagtatgca

SEQ ID NO: 7951 - DNA, 22 bp, Artificial Sequence
  Synthetic polynucleotide
gcagtttagtacaaaaacctga

SEQ ID NO: 7952 - DNA, 19 bp, Artificial Sequence
  Synthetic polynucleotide
gatgtacactgtagctccc

SEQ ID NO: 7953 - DNA, 20 bp, Artificial Sequence
  Synthetic polynucleotide
ggatccagtaatgtggctag

SEQ ID NO: 7954 - DNA, 20 bp, Artificial Sequence
  Synthetic polynucleotide
gcatgtaggaatggaggtag

SEQ ID NO: 7955 - DNA, 20 bp, Artificial Sequence
  Synthetic polynucleotide
caatcctccaccaccaaata

SEQ ID NO: 7956 - DNA, 20 bp, Artificial Sequence
  Synthetic polynucleotide
tgaactcccaaaagtctagc

SEQ ID NO: 7957 - DNA, 20 bp, Artificial Sequence
  Synthetic polynucleotide
gaacccacattagacgagtt

SEQ ID NO: 7958 - DNA, 20 bp, Artificial Sequence
  Synthetic polynucleotide
aaagttggtgtctctcgttt

SEQ ID NO: 7959 - DNA, 20 bp, Artificial Sequence
  Synthetic polynucleotide
tgctatggacacagaattcc

SEQ ID NO: 7960 - DNA, 20 bp, Artificial Sequence
  Synthetic polynucleotide
agtcgtctattgtgtcttcg

SEQ ID NO: 7961 - DNA, 20 bp, Artificial Sequence
  Synthetic polynucleotide
tctggtactggtaaaacagc

SEQ ID NO: 7962 - DNA, 20 bp, Artificial Sequence
  Synthetic polynucleotide
ttgttgtacgtcgatacctc

SEQ ID NO: 7963 - DNA, 20 bp, Artificial Sequence
  Synthetic polynucleotide
agaaagctggatgcaatgta

SEQ ID NO: 7964 - DNA, 20 bp, Artificial Sequence
  Synthetic polynucleotide
tcaatgctgaagtgctaact

SEQ ID NO: 7965 - DNA, 20 bp, Artificial Sequence
  Synthetic polynucleotide
caaaacactggtatcgttgg

SEQ ID NO: 7966 - DNA, 20 bp, Artificial Sequence
  Synthetic polynucleotide
tgctgaaaatcaaacgcttt

SEQ ID NO: 7967 - DNA, 20 bp, Artificial Sequence
  Synthetic polynucleotide
aaatgctccgtcactatcaa

SEQ ID NO: 7968 - DNA, 20 bp, Artificial Sequence
  Synthetic polynucleotide
taagagccccttgatatcca

SEQ ID NO: 7969 - DNA, 20 bp, Artificial Sequence
  Synthetic polynucleotide
gaatgcaagcaattaacgga

SEQ ID NO: 7970 - DNA, 20 bp, Artificial Sequence
  Synthetic polynucleotide
gcatcggtagcaataattgg

SEQ ID NO: 7971 - DNA, 20 bp, Artificial Sequence
  Synthetic polynucleotide
accatcagataccatcgaga

SEQ ID NO: 7972 - DNA, 20 bp, Artificial Sequence
  Synthetic polynucleotide
tctgatggttcaacctcaag

SEQ ID NO: 7973 - DNA, 20 bp, Artificial Sequence
  Synthetic polynucleotide
ctatatcaaacgatggggca

SEQ ID NO: 7974 - DNA, 20 bp, Artificial Sequence
  Synthetic polynucleotide
agtagcaacatctccaatgg

SEQ ID NO: 7975 - DNA, 20 bp, Artificial Sequence
  Synthetic polynucleotide
tttttacagagcctcagacc

SEQ ID NO: 7976 - DNA, 20 bp, Artificial Sequence
  Synthetic polynucleotide
ccagaaactccgatcagtag

SEQ ID NO: 7977 - DNA, 20 bp, Artificial Sequence
  Synthetic polynucleotide
ggagatccagcggataaatt

SEQ ID NO: 7978 - DNA, 20 bp, Artificial Sequence
  Synthetic polynucleotide
cccacctaggtaatgattcg

SEQ ID NO: 7979 - DNA, 20 bp, Artificial Sequence
  Synthetic polynucleotide
ggtaaaacagcaattgcact

SEQ ID NO: 7980 - DNA, 20 bp, Artificial Sequence
  Synthetic polynucleotide
tatccaacatgtgcacttca

SEQ ID NO: 7981 - DNA, 20 bp, Artificial Sequence
  Synthetic polynucleotide
ttaaatggttgtgagctcga

SEQ ID NO: 7982 - DNA, 20 bp, Artificial Sequence
  Synthetic polynucleotide
tgtcatgtctacctttggtg

SEQ ID NO: 7983 - DNA, 20 bp, Artificial Sequence
  Synthetic polynucleotide
aacagccctttatacccaag

SEQ ID NO: 7984 - DNA, 20 bp, Artificial Sequence
  Synthetic polynucleotide
gttgaatagatggtggtggt

SEQ ID NO: 7985 - DNA, 20 bp, Artificial Sequence
  Synthetic polynucleotide
ttaatcgcatgggcaaaatc

SEQ ID NO: 7986 - DNA, 20 bp, Artificial Sequence
  Synthetic polynucleotide
tccgcgtctctatttgttag

SEQ ID NO: 7987 - DNA, 20 bp, Artificial Sequence
  Synthetic polynucleotide
gaacaacacattcatccgac

SEQ ID NO: 7988 - DNA, 20 bp, Artificial Sequence
  Synthetic polynucleotide
tcgaccacaaagcagaaata

SEQ ID NO: 7989 - DNA, 20 bp, Artificial Sequence
  Synthetic polynucleotide
atgcaacgtcaaattaaccc

SEQ ID NO: 7990 - DNA, 20 bp, Artificial Sequence
  Synthetic polynucleotide
tctctttcagcagcagaaat

SEQ ID NO: 7991 - DNA, 20 bp, Artificial Sequence
  Synthetic polynucleotide
gagaagacgttgaaagaggt

SEQ ID NO: 7992 - DNA, 20 bp, Artificial Sequence
  Synthetic polynucleotide
ctgacataagttggtttgcc

SEQ ID NO: 7993 - DNA, 20 bp, Artificial Sequence
  Synthetic polynucleotide
ggttggtggaaaattggaag

SEQ ID NO: 7994 - DNA, 20 bp, Artificial Sequence
  Synthetic polynucleotide
gttccaaggaagctagttga

SEQ ID NO: 7995 - DNA, 22 bp, Artificial Sequence
  Synthetic polynucleotide
aggagaaaagaaacgttttgaa

SEQ ID NO: 7996 - DNA, 20 bp, Artificial Sequence
  Synthetic polynucleotide
tggaagtgaaaggcatgatt

SEQ ID NO: 7997 - DNA, 20 bp, Artificial Sequence
  Synthetic polynucleotide
gatagccaacactcctatgg

SEQ ID NO: 7998 - DNA, 20 bp, Artificial Sequence
  Synthetic polynucleotide
gattctgtgattcccaaggt

SEQ ID NO: 7999 - DNA, 20 bp, Artificial Sequence
  Synthetic polynucleotide
gcatcaggtagaatatgcca

SEQ ID NO: 8000 - DNA, 20 bp, Artificial Sequence
  Synthetic polynucleotide
catctctcaatggatctgca

SEQ ID NO: 8001 - DNA, 20 bp, Artificial Sequence
  Synthetic polynucleotide
tcaaagtagacgatttggca

SEQ ID NO: 8002 - DNA, 20 bp, Artificial Sequence
  Synthetic polynucleotide
gtgagcatatatagctcggg

SEQ ID NO: 8003 - DNA, 20 bp, Artificial Sequence
  Synthetic polynucleotide
ctattgtgggagctctttgt

SEQ ID NO: 8004 - DNA, 20 bp, Artificial Sequence
  Synthetic polynucleotide
ggcaagtttgatagtgttgg

SEQ ID NO: 8005 - DNA, 20 bp, Artificial Sequence
  Synthetic polynucleotide
agcacccaaactacgttatt

SEQ ID NO: 8006 - DNA, 20 bp, Artificial Sequence
  Synthetic polynucleotide
aagaccaactttacgaccag

SEQ ID NO: 8007 - DNA, 20 bp, Artificial Sequence
  Synthetic polynucleotide
cagttagcaactaaagctgc

SEQ ID NO: 8008 - DNA, 20 bp, Artificial Sequence
  Synthetic polynucleotide
tcttagcatgaatagcgcat

SEQ ID NO: 8009 - DNA, 20 bp, Artificial Sequence
  Synthetic polynucleotide
tacatagcagaaggtctcca

SEQ ID NO: 8010 - DNA, 20 bp, Artificial Sequence
  Synthetic polynucleotide
ctgttcatagctactccacc

SEQ ID NO: 8011 - DNA, 20 bp, Artificial Sequence
  Synthetic polynucleotide
agagaacaaatcgcagaagt

SEQ ID NO: 8012 - DNA, 20 bp, Artificial Sequence
  Synthetic polynucleotide
gaacgaatacagcatgcaaa

SEQ ID NO: 8013 - DNA, 20 bp, Artificial Sequence
  Synthetic polynucleotide
ctcaagctgttattggcatg

SEQ ID NO: 8014 - DNA, 20 bp, Artificial Sequence
  Synthetic polynucleotide
tacgaaaatgacaacctggt

SEQ ID NO: 8015 - DNA, 20 bp, Artificial Sequence
  Synthetic polynucleotide
ccaacactagaaggaagctt

SEQ ID NO: 8016 - DNA, 20 bp, Artificial Sequence
  Synthetic polynucleotide
tctgaaaccaatagcagcat

SEQ ID NO: 8017 - DNA, 20 bp, Artificial Sequence
  Synthetic polynucleotide
gagtactcaaacatcgacga

SEQ ID NO: 8018 - DNA, 20 bp, Artificial Sequence
  Synthetic polynucleotide
gtgcttctaaatgttcctgc

SEQ ID NO: 8019 - DNA, 20 bp, Artificial Sequence
  Synthetic polynucleotide
gcctcctgtggattttagtt

SEQ ID NO: 8020 - DNA, 20 bp, Artificial Sequence
  Synthetic polynucleotide
atcagctctaccacattgtc

SEQ ID NO: 8021 - DNA, 20 bp, Artificial Sequence
  Synthetic polynucleotide
ggatactgccgaacaagtat

SEQ ID NO: 8022 - DNA, 20 bp, Artificial Sequence
  Synthetic polynucleotide
agctgttctggagtcatttt

SEQ ID NO: 8023 - DNA, 20 bp, Artificial Sequence
  Synthetic polynucleotide
gcaagctcagagaaatgaac

SEQ ID NO: 8024 - DNA, 20 bp, Artificial Sequence
  Synthetic polynucleotide
agtaaagcgggatccaaaat

SEQ ID NO: 8025 - DNA, 20 bp, Artificial Sequence
  Synthetic polynucleotide
acctggttgaaatcagcttt

SEQ ID NO: 8026 - DNA, 20 bp, Artificial Sequence
  Synthetic polynucleotide
atgcttaaaccttccgactt

SEQ ID NO: 8027 - DNA, 20 bp, Artificial Sequence
  Synthetic polynucleotide
catattggatgtgccgtttc

SEQ ID NO: 8028 - DNA, 24 bp, Artificial Sequence
  Synthetic polynucleotide
ggaacatatcttttggagtcatag

SEQ ID NO: 8029 - DNA, 20 bp, Artificial Sequence
  Synthetic polynucleotide
atgttattcttgcgagtggt

SEQ ID NO: 8030 - DNA, 20 bp, Artificial Sequence
  Synthetic polynucleotide
gcttttcggttatctcgaac

SEQ ID NO: 8031 - DNA, 20 bp, Artificial Sequence
  Synthetic polynucleotide
tcccgttacaacatcaactt

SEQ ID NO: 8032 - DNA, 20 bp, Artificial Sequence
  Synthetic polynucleotide
aacacttccatgcatttgtg

SEQ ID NO: 8033 - DNA, 20 bp, Artificial Sequence
  Synthetic polynucleotide
aagagtggttggacaagttt

SEQ ID NO: 8034 - DNA, 20 bp, Artificial Sequence
  Synthetic polynucleotide
cgaagtctggggcataaata

SEQ ID NO: 8035 - DNA, 20 bp, Artificial Sequence
  Synthetic polynucleotide
gtggttctaggagcaaaaga

SEQ ID NO: 8036 - DNA, 20 bp, Artificial Sequence
  Synthetic polynucleotide
catccttgggtaacaatcca

SEQ ID NO: 8037 - DNA, 20 bp, Artificial Sequence
  Synthetic polynucleotide
ttctcttttggtagctggac

SEQ ID NO: 8038 - DNA, 20 bp, Artificial Sequence
  Synthetic polynucleotide
taccaaccgcaacaaatcta

SEQ ID NO: 8039 - DNA, 20 bp, Artificial Sequence
  Synthetic polynucleotide
tcgaagtacaactctgcaaa

SEQ ID NO: 8040 - DNA, 20 bp, Artificial Sequence
  Synthetic polynucleotide
aacgttcctaaatgtgctct

SEQ ID NO: 8041 - DNA, 20 bp, Artificial Sequence
  Synthetic polynucleotide
tggcagaaaaatatgaggct

SEQ ID NO: 8042 - DNA, 20 bp, Artificial Sequence
  Synthetic polynucleotide
ccttcaagctttagtgacct

SEQ ID NO: 8043 - DNA, 20 bp, Artificial Sequence
  Synthetic polynucleotide
agattcggaagattcgacag

SEQ ID NO: 8044 - DNA, 20 bp, Artificial Sequence
  Synthetic polynucleotide
atcacctacatttccaccac

SEQ ID NO: 8045 - DNA, 20 bp, Artificial Sequence
  Synthetic polynucleotide
gttcccagtctatgtgaaga

SEQ ID NO: 8046 - DNA, 20 bp, Artificial Sequence
  Synthetic polynucleotide
tggttgaactgatcgtagac

SEQ ID NO: 8047 - DNA, 20 bp, Artificial Sequence
  Synthetic polynucleotide
catgactaccacgacatcat

SEQ ID NO: 8048 - DNA, 20 bp, Artificial Sequence
  Synthetic polynucleotide
gatgcatgttcagggatttg

SEQ ID NO: 8049 - DNA, 20 bp, Artificial Sequence
  Synthetic polynucleotide
atgagcaaaggacatgtcat

SEQ ID NO: 8050 - DNA, 20 bp, Artificial Sequence
  Synthetic polynucleotide
ctggatctaatcacgacgtt

SEQ ID NO: 8051 - DNA, 20 bp, Artificial Sequence
  Synthetic polynucleotide
gaaggaaattcaagcgactg

SEQ ID NO: 8052 - DNA, 20 bp, Artificial Sequence
  Synthetic polynucleotide
tgcttttctgatctttccga

SEQ ID NO: 8053 - DNA, 20 bp, Artificial Sequence
  Synthetic polynucleotide
agtggcacatgaaattttgg

SEQ ID NO: 8054 - DNA, 20 bp, Artificial Sequence
  Synthetic polynucleotide
aaaggctcgatgtacacttt

SEQ ID NO: 8055 - DNA, 20 bp, Artificial Sequence
  Synthetic polynucleotide
tagcattcattccgactgag

SEQ ID NO: 8056 - DNA, 20 bp, Artificial Sequence
  Synthetic polynucleotide
atccttgattttctcgcctt

SEQ ID NO: 8057 - DNA, 20 bp, Artificial Sequence
  Synthetic polynucleotide
agtcaaatgggatgtctgtc

SEQ ID NO: 8058 - DNA, 20 bp, Artificial Sequence
  Synthetic polynucleotide
cttctacaacaggaacagct

SEQ ID NO: 8059 - DNA, 20 bp, Artificial Sequence
  Synthetic polynucleotide
tcttggtcggaaactaacag

SEQ ID NO: 8060 - DNA, 20 bp, Artificial Sequence
  Synthetic polynucleotide
ataggattgaacatcggtgg

SEQ ID NO: 8061 - DNA, 20 bp, Artificial Sequence
  Synthetic polynucleotide
aacaattaccggcgaagtat

SEQ ID NO: 8062 - DNA, 18 bp, Artificial Sequence
  Synthetic polynucleotide
gttgttgttgccccctac

SEQ ID NO: 8063 - DNA, 20 bp, Artificial Sequence
  Synthetic polynucleotide
tcaacaagttggtgcaaatc

SEQ ID NO: 8064 - DNA, 20 bp, Artificial Sequence
  Synthetic polynucleotide
taacagctgattgaactgct

SEQ ID NO: 8065 - DNA, 20 bp, Artificial Sequence
  Synthetic polynucleotide
atctgcaagaaaagattggc

SEQ ID NO: 8066 - DNA, 23 bp, Artificial Sequence
  Synthetic polynucleotide
cacaaataaatacaggatgaggt

SEQ ID NO: 8067 - DNA, 20 bp, Artificial Sequence
  Synthetic polynucleotide
ggctctggaaaacctattga

SEQ ID NO: 8068 - DNA, 20 bp, Artificial Sequence
  Synthetic polynucleotide
tcgggaatagggtgagtaat

SEQ ID NO: 8069 - DNA, 20 bp, Artificial Sequence
  Synthetic polynucleotide
tttactggaacaacctggag

SEQ ID NO: 8070 - DNA, 20 bp, Artificial Sequence
  Synthetic polynucleotide
gtttctgcgaacactgattt

SEQ ID NO: 8071 - DNA, 20 bp, Artificial Sequence
  Synthetic polynucleotide
ttatcacaccacagacaagg

SEQ ID NO: 8072 - DNA, 20 bp, Artificial Sequence
  Synthetic polynucleotide
gccatttctgattccacatg

SEQ ID NO: 8073 - DNA, 20 bp, Artificial Sequence
  Synthetic polynucleotide
taagcacaaaaagcgaagac

SEQ ID NO: 8074 - DNA, 20 bp, Artificial Sequence
  Synthetic polynucleotide
tacaggtacatgtgcaacaa

SEQ ID NO: 8075 - DNA, 20 bp, Artificial Sequence
  Synthetic polynucleotide
acatgactggtgaattcgaa

SEQ ID NO: 8076 - DNA, 20 bp, Artificial Sequence
  Synthetic polynucleotide
tccttttcgatttgttgctg

SEQ ID NO: 8077 - DNA, 20 bp, Artificial Sequence
  Synthetic polynucleotide
atctaccgagacctcaagaa

SEQ ID NO: 8078 - DNA, 20 bp, Artificial Sequence
  Synthetic polynucleotide
cagcttcctttctctgttct

SEQ ID NO: 8079 - DNA, 20 bp, Artificial Sequence
  Synthetic polynucleotide
aaatggtatgtggctcatcc

SEQ ID NO: 8080 - DNA, 20 bp, Artificial Sequence
  Synthetic polynucleotide
acttgtctcctgaacttcac

SEQ ID NO: 8081 - DNA, 20 bp, Artificial Sequence
  Synthetic polynucleotide
ttcgagaggaagctcaaaaa

SEQ ID NO: 8082 - DNA, 20 bp, Artificial Sequence
  Synthetic polynucleotide
aagattgaatgggccttcat

SEQ ID NO: 8083 - DNA, 20 bp, Artificial Sequence
  Synthetic polynucleotide
acctggcttaaatactgtgg

SEQ ID NO: 8084 - DNA, 20 bp, Artificial Sequence
  Synthetic polynucleotide
atctgcagcactatctcttg

SEQ ID NO: 8085 - DNA, 20 bp, Artificial Sequence
  Synthetic polynucleotide
gctccagtaaaggatatggg

SEQ ID NO: 8086 - DNA, 20 bp, Artificial Sequence
  Synthetic polynucleotide
atctccgttactgcttttgt

SEQ ID NO: 8087 - DNA, 20 bp, Artificial Sequence
  Synthetic polynucleotide
ggatctgctgaagacactag

SEQ ID NO: 8088 - DNA, 20 bp, Artificial Sequence
  Synthetic polynucleotide
cggaatgtctctccaagtag

SEQ ID NO: 8089 - DNA, 20 bp, Artificial Sequence
  Synthetic polynucleotide
gaagttggagctacctcttc

SEQ ID NO: 8090 - DNA, 20 bp, Artificial Sequence
  Synthetic polynucleotide
tgattgggctgttcctaaaa

SEQ ID NO: 8091 - DNA, 20 bp, Artificial Sequence
  Synthetic polynucleotide
cacttgtagatgctggagtt

SEQ ID NO: 8092 - DNA, 20 bp, Artificial Sequence
  Synthetic polynucleotide
attaggcccgatttgacaat

SEQ ID NO: 8093 - DNA, 20 bp, Artificial Sequence
  Synthetic polynucleotide
acctcttaaaagaaggtgcc

SEQ ID NO: 8094 - DNA, 20 bp, Artificial Sequence
  Synthetic polynucleotide
gccttgaaggttgtatctga

SEQ ID NO: 8095 - DNA, 20 bp, Artificial Sequence
  Synthetic polynucleotide
ggtatctggaattcagcgat

SEQ ID NO: 8096 - DNA, 20 bp, Artificial Sequence
  Synthetic polynucleotide
cactttcaggagcgaatttc

SEQ ID NO: 8097 - DNA, 20 bp, Artificial Sequence
  Synthetic polynucleotide
ataagtaagcagccacgtaa

SEQ ID NO: 8098 - DNA, 20 bp, Artificial Sequence
  Synthetic polynucleotide
gcctctttcttttcttcagc

SEQ ID NO: 8099 - DNA, 20 bp, Artificial Sequence
  Synthetic polynucleotide
aagggaaaggatagttgcag

SEQ ID NO: 8100 - DNA, 20 bp, Artificial Sequence
  Synthetic polynucleotide
agctgttactacattgcaca

SEQ ID NO: 8101 - DNA, 20 bp, Artificial Sequence
  Synthetic polynucleotide
aactacaaaggccactacag

SEQ ID NO: 8102 - DNA, 20 bp, Artificial Sequence
  Synthetic polynucleotide
atcggtacaatcagctcttc

SEQ ID NO: 8103 - DNA, 20 bp, Artificial Sequence
  Synthetic polynucleotide
cttaggactggataacgcag

SEQ ID NO: 8104 - DNA, 20 bp, Artificial Sequence
  Synthetic polynucleotide
tagttctagaggcctaccag

SEQ ID NO: 8105 - DNA, 20 bp, Artificial Sequence
  Synthetic polynucleotide
aggtgtttccttcaggagat

SEQ ID NO: 8106 - DNA, 23 bp, Artificial Sequence
  Synthetic polynucleotide
tatcagtgaaatcttgtagagct

SEQ ID NO: 8107 - DNA, 20 bp, Artificial Sequence
  Synthetic polynucleotide
agtggcaactttatatggca

SEQ ID NO: 8108 - DNA, 20 bp, Artificial Sequence
  Synthetic polynucleotide
gattcggttgagtattccga

SEQ ID NO: 8109 - DNA, 20 bp, Artificial Sequence
  Synthetic polynucleotide
agattccagcctcagactat

SEQ ID NO: 8110 - DNA, 20 bp, Artificial Sequence
  Synthetic polynucleotide
caacctccatttcctcatca

SEQ ID NO: 8111 - DNA, 20 bp, Artificial Sequence
  Synthetic polynucleotide
ctacagccgaattggtgata

SEQ ID NO: 8112 - DNA, 20 bp, Artificial Sequence
  Synthetic polynucleotide
tacaatgcaatcttcctgct

SEQ ID NO: 8113 - DNA, 20 bp, Artificial Sequence
  Synthetic polynucleotide
cgcagcaacaacagaatatt

SEQ ID NO: 8114 - DNA, 20 bp, Artificial Sequence
  Synthetic polynucleotide
accctaatagtaccaggtcc

SEQ ID NO: 8115 - DNA, 20 bp, Artificial Sequence
  Synthetic polynucleotide
tgcatcaacaggaaaacttg

SEQ ID NO: 8116 - DNA, 20 bp, Artificial Sequence
  Synthetic polynucleotide
gcaatcctttttctgagtcc

SEQ ID NO: 8117 - DNA, 20 bp, Artificial Sequence
  Synthetic polynucleotide
ccatacttcagaaccaccaa

SEQ ID NO: 8118 - DNA, 20 bp, Artificial Sequence
  Synthetic polynucleotide
cggcatctgttaaagtttcc

SEQ ID NO: 8119 - DNA, 20 bp, Artificial Sequence
  Synthetic polynucleotide
atcagttcccaaagtggatc

SEQ ID NO: 8120 - DNA, 20 bp, Artificial Sequence
  Synthetic polynucleotide
atcttcttcgctaagagcag

SEQ ID NO: 8121 - DNA, 20 bp, Artificial Sequence
  Synthetic polynucleotide
aaggccaaagattccgttat

SEQ ID NO: 8122 - DNA, 20 bp, Artificial Sequence
  Synthetic polynucleotide
atgacaattcaaacgtcgtg

SEQ ID NO: 8123 - DNA, 20 bp, Artificial Sequence
  Synthetic polynucleotide
ggctaccataaatttggcac

SEQ ID NO: 8124 - DNA, 20 bp, Artificial Sequence
  Synthetic polynucleotide
cttctccaatactgcttggt

SEQ ID NO: 8125 - DNA, 20 bp, Artificial Sequence
  Synthetic polynucleotide
cttgaacccatttcagttcg

SEQ ID NO: 8126 - DNA, 19 bp, Artificial Sequence
  Synthetic polynucleotide
tacttcgacaggagcagag

SEQ ID NO: 8127 - DNA, 20 bp, Artificial Sequence
  Synthetic polynucleotide
tgtctgtaccacaaaccaaa

SEQ ID NO: 8128 - DNA, 20 bp, Artificial Sequence
  Synthetic polynucleotide
tttcctgtcttactttcgca

SEQ ID NO: 8129 - DNA, 20 bp, Artificial Sequence
  Synthetic polynucleotide
tatgccgaccaaatgaactt

SEQ ID NO: 8130 - DNA, 20 bp, Artificial Sequence
  Synthetic polynucleotide
tcagcaagaatctgaactga

SEQ ID NO: 8131 - DNA, 20 bp, Artificial Sequence
  Synthetic polynucleotide
caaggaaggagaatgggaaa

SEQ ID NO: 8132 - DNA, 20 bp, Artificial Sequence
  Synthetic polynucleotide
ccgtcgagatcactaagttt

SEQ ID NO: 8133 - DNA, 20 bp, Artificial Sequence
  Synthetic polynucleotide
cgcgaaaggtggatatgtat

SEQ ID NO: 8134 - DNA, 20 bp, Artificial Sequence
  Synthetic polynucleotide
gagcttttattttgcctgct

SEQ ID NO: 8135 - DNA, 20 bp, Artificial Sequence
  Synthetic polynucleotide
gatatgggagagagcacttg

SEQ ID NO: 8136 - DNA, 20 bp, Artificial Sequence
  Synthetic polynucleotide
tgtgatcgagagcatacttg

SEQ ID NO: 8137 - DNA, 20 bp, Artificial Sequence
  Synthetic polynucleotide
atcgtgtacgtaatgacagg

SEQ ID NO: 8138 - DNA, 20 bp, Artificial Sequence
  Synthetic polynucleotide
acatgaagacgatgtagagc

SEQ ID NO: 8139 - DNA, 21 bp, Artificial Sequence
  Synthetic polynucleotide
acatttcaagggtactagagc

SEQ ID NO: 8140 - DNA, 20 bp, Artificial Sequence
  Synthetic polynucleotide
gtacctgtcctcctgttttt

SEQ ID NO: 8141 - DNA, 20 bp, Artificial Sequence
  Synthetic polynucleotide
cgtggaagaaaagcactttt

SEQ ID NO: 8142 - DNA, 20 bp, Artificial Sequence
  Synthetic polynucleotide
cattttaggaacacagcgac

SEQ ID NO: 8143 - DNA, 20 bp, Artificial Sequence
  Synthetic polynucleotide
agagaaacatactctcggga

SEQ ID NO: 8144 - DNA, 20 bp, Artificial Sequence
  Synthetic polynucleotide
agtttctgtgtcccaaagtt

SEQ ID NO: 8145 - DNA, 20 bp, Artificial Sequence
  Synthetic polynucleotide
ccactttttgaaaagaggcc

SEQ ID NO: 8146 - DNA, 20 bp, Artificial Sequence
  Synthetic polynucleotide
caatacgagcagcagatttg

SEQ ID NO: 8147 - DNA, 20 bp, Artificial Sequence
  Synthetic polynucleotide
atccagaaagtggtggaatc

SEQ ID NO: 8148 - DNA, 20 bp, Artificial Sequence
  Synthetic polynucleotide
agaatcatgtcccaaaaggg

SEQ ID NO: 8149 - DNA, 20 bp, Artificial Sequence
  Synthetic polynucleotide
gaaaccggtactccagatac

SEQ ID NO: 8150 - DNA, 20 bp, Artificial Sequence
  Synthetic polynucleotide
ttcatcacagtatggtagcg

SEQ ID NO: 8151 - DNA, 20 bp, Artificial Sequence
  Synthetic polynucleotide
tagaaggcatccaaacgaaa

SEQ ID NO: 8152 - DNA, 20 bp, Artificial Sequence
  Synthetic polynucleotide
gtctctttctccgtcagtac

SEQ ID NO: 8153 - DNA, 20 bp, Artificial Sequence
  Synthetic polynucleotide
ttggaactttcaaagcgttc

SEQ ID NO: 8154 - DNA, 19 bp, Artificial Sequence
  Synthetic polynucleotide
gtcctctcattcccattgg

SEQ ID NO: 8155 - DNA, 20 bp, Artificial Sequence
  Synthetic polynucleotide
acagctttcggttaggattt

SEQ ID NO: 8156 - DNA, 20 bp, Artificial Sequence
  Synthetic polynucleotide
accgccagattatcaactac

SEQ ID NO: 8157 - DNA, 20 bp, Artificial Sequence
  Synthetic polynucleotide
ctccaactaaaccggaagaa

SEQ ID NO: 8158 - DNA, 20 bp, Artificial Sequence
  Synthetic polynucleotide
tttgatcgcccattaagaca

SEQ ID NO: 8159 - DNA, 20 bp, Artificial Sequence
  Synthetic polynucleotide
agctgaacagaagaagaagg

SEQ ID NO: 8160 - DNA, 20 bp, Artificial Sequence
  Synthetic polynucleotide
cgtcttcgactatgactgtt

SEQ ID NO: 8161 - DNA, 20 bp, Artificial Sequence
  Synthetic polynucleotide
aatcaagtacctgcgacttt

SEQ ID NO: 8162 - DNA, 20 bp, Artificial Sequence
  Synthetic polynucleotide
tgctcatcggataattggag

SEQ ID NO: 8163 - DNA, 20 bp, Artificial Sequence
  Synthetic polynucleotide
tgtcacttattccgccatag

SEQ ID NO: 8164 - DNA, 20 bp, Artificial Sequence
  Synthetic polynucleotide
cacatttcttaaatcggccc

SEQ ID NO: 8165 - DNA, 20 bp, Artificial Sequence
  Synthetic polynucleotide
atcaagtggagtatgccatg

SEQ ID NO: 8166 - DNA, 20 bp, Artificial Sequence
  Synthetic polynucleotide
cggatttttcgtactcggaa

SEQ ID NO: 8167 - DNA, 20 bp, Artificial Sequence
  Synthetic polynucleotide
actaccacgattatgcagac

SEQ ID NO: 8168 - DNA, 20 bp, Artificial Sequence
  Synthetic polynucleotide
tgtttggatctttagcgtga

SEQ ID NO: 8169 - DNA, 20 bp, Artificial Sequence
  Synthetic polynucleotide
gcgtgatccgaagaaatttt

SEQ ID NO: 8170 - DNA, 20 bp, Artificial Sequence
  Synthetic polynucleotide
ccggtctcttgactagattg

SEQ ID NO: 8171 - DNA, 20 bp, Artificial Sequence
  Synthetic polynucleotide
ccttggataatttgctgcag

SEQ ID NO: 8172 - DNA, 20 bp, Artificial Sequence
  Synthetic polynucleotide
acgctaaggtaaaagcagaa

SEQ ID NO: 8173 - DNA, 20 bp, Artificial Sequence
  Synthetic polynucleotide
caaacagtagccacgaattt

SEQ ID NO: 8174 - DNA, 20 bp, Artificial Sequence
  Synthetic polynucleotide
atataaacggtagctcccca

SEQ ID NO: 8175 - DNA, 20 bp, Artificial Sequence
  Synthetic polynucleotide
tgcaaaccggtaataatgga

SEQ ID NO: 8176 - DNA, 20 bp, Artificial Sequence
  Synthetic polynucleotide
aataattccaaaccgttcgc

SEQ ID NO: 8177 - DNA, 20 bp, Artificial Sequence
  Synthetic polynucleotide
agattccacgattatgcgaa

SEQ ID NO: 8178 - DNA, 20 bp, Artificial Sequence
  Synthetic polynucleotide
gtcttaagggtatcgtccac

SEQ ID NO: 8179 - DNA, 20 bp, Artificial Sequence
  Synthetic polynucleotide
cgtttgggctcacaatttag

SEQ ID NO: 8180 - DNA, 20 bp, Artificial Sequence
  Synthetic polynucleotide
gtcagaagtgagtcagatcc

SEQ ID NO: 8181 - DNA, 20 bp, Artificial Sequence
  Synthetic polynucleotide
tgacaatgagagaaacccag

SEQ ID NO: 8182 - DNA, 20 bp, Artificial Sequence
  Synthetic polynucleotide
ttgttgtacgtcgatacctc

SEQ ID NO: 8183 - DNA, 20 bp, Artificial Sequence
  Synthetic polynucleotide
tactgtggaagataccgagt

SEQ ID NO: 8184 - DNA, 20 bp, Artificial Sequence
  Synthetic polynucleotide
gagagcaacttcaatttcgg

SEQ ID NO: 8185 - DNA, 20 bp, Artificial Sequence
  Synthetic polynucleotide
gaaattacagcagacgttgg

SEQ ID NO: 8186 - DNA, 20 bp, Artificial Sequence
  Synthetic polynucleotide
cgaaccgtttagtggctata

SEQ ID NO: 8187 - DNA, 20 bp, Artificial Sequence
  Synthetic polynucleotide
cggtgaccataaaaaccatg

SEQ ID NO: 8188 - DNA, 19 bp, Artificial Sequence
  Synthetic polynucleotide
gttttccgtatctcctccg

SEQ ID NO: 8189 - DNA, 20 bp, Artificial Sequence
  Synthetic polynucleotide
tgtgtgataaggcgaaagaa

SEQ ID NO: 8190 - DNA, 20 bp, Artificial Sequence
  Synthetic polynucleotide
agatagtcacgacgtttctg

SEQ ID NO: 8191 - DNA, 20 bp, Artificial Sequence
  Synthetic polynucleotide
gtaagcaattggaagatggc

SEQ ID NO: 8192 - DNA, 20 bp, Artificial Sequence
  Synthetic polynucleotide
ggattccttctggatgttgt

SEQ ID NO: 8193 - DNA, 20 bp, Artificial Sequence
  Synthetic polynucleotide
gaagcaactgaagtcctaca

SEQ ID NO: 8194 - DNA, 20 bp, Artificial Sequence
  Synthetic polynucleotide
gttacctagcacatcgtctt

SEQ ID NO: 8195 - DNA, 20 bp, Artificial Sequence
  Synthetic polynucleotide
aaagatgatgacaacgtcca

SEQ ID NO: 8196 - DNA, 20 bp, Artificial Sequence
  Synthetic polynucleotide
tcgttaactgtagctatggc

SEQ ID NO: 8197 - DNA, 20 bp, Artificial Sequence
  Synthetic polynucleotide
gacgatgagtacttgttcga

SEQ ID NO: 8198 - DNA, 20 bp, Artificial Sequence
  Synthetic polynucleotide
ctttcggaagtgcaatcttc

SEQ ID NO: 8199 - DNA, 20 bp, Artificial Sequence
  Synthetic polynucleotide
ggaagtgggagatgtcattt

SEQ ID NO: 8200 - DNA, 20 bp, Artificial Sequence
  Synthetic polynucleotide
cgcttttgagaatgttaccc

SEQ ID NO: 8201 - DNA, 20 bp, Artificial Sequence
  Synthetic polynucleotide
cgaaggagcaagaaacaatc

SEQ ID NO: 8202 - DNA, 20 bp, Artificial Sequence
  Synthetic polynucleotide
ttctccgtctgatctacctt

SEQ ID NO: 8203 - DNA, 20 bp, Artificial Sequence
  Synthetic polynucleotide
tggtaaaacttcgagttcgt

SEQ ID NO: 8204 - DNA, 20 bp, Artificial Sequence
  Synthetic polynucleotide
gaatgttaggcataggaggg

SEQ ID NO: 8205 - DNA, 20 bp, Artificial Sequence
  Synthetic polynucleotide
agtggaccatttcaatcgaa

SEQ ID NO: 8206 - DNA, 20 bp, Artificial Sequence
  Synthetic polynucleotide
tggtttatatcgggcaacaa

SEQ ID NO: 8207 - DNA, 20 bp, Artificial Sequence
  Synthetic polynucleotide
agatcgaaacgacaaaaacg

SEQ ID NO: 8208 - DNA, 20 bp, Artificial Sequence
  Synthetic polynucleotide
cagattcctctcgatttcgt

SEQ ID NO: 8209 - DNA, 20 bp, Artificial Sequence
  Synthetic polynucleotide
cgttgaacgccagattaatc

SEQ ID NO: 8210 - DNA, 20 bp, Artificial Sequence
  Synthetic polynucleotide
gcagcggatatgaaaacatc

SEQ ID NO: 8211 - DNA, 20 bp, Artificial Sequence
  Synthetic polynucleotide
tcgaacgtggaggaaaaata

SEQ ID NO: 8212 - DNA, 20 bp, Artificial Sequence
  Synthetic polynucleotide
gcgtgcctatttgataatcg

SEQ ID NO: 8213 - DNA, 20 bp, Artificial Sequence
  Synthetic polynucleotide
gaaataggggacggaactac

SEQ ID NO: 8214 - DNA, 20 bp, Artificial Sequence
  Synthetic polynucleotide
gaactattcttcctccggtc

SEQ ID NO: 8215 - DNA, 20 bp, Artificial Sequence
  Synthetic polynucleotide
gtgaaaaagtggaatgctgt

SEQ ID NO: 8216 - DNA, 21 bp, Artificial Sequence
  Synthetic polynucleotide
cctgcctagtttttaaccatc

SEQ ID NO: 8217 - DNA, 20 bp, Artificial Sequence
  Synthetic polynucleotide
accttgagctcgaaaattct

SEQ ID NO: 8218 - DNA, 20 bp, Artificial Sequence
  Synthetic polynucleotide
tccttaccagctgtgttaac

SEQ ID NO: 8219 - DNA, 20 bp, Artificial Sequence
  Synthetic polynucleotide
aaggacgtcttcatcaagtc

SEQ ID NO: 8220 - DNA, 20 bp, Artificial Sequence
  Synthetic polynucleotide
ttcaccctcgattaaagcaa

SEQ ID NO: 8221 - DNA, 20 bp, Artificial Sequence
  Synthetic polynucleotide
gttacggtggcagtaaattg

SEQ ID NO: 8222 - DNA, 20 bp, Artificial Sequence
  Synthetic polynucleotide
aatttcatcgggattgacca

SEQ ID NO: 8223 - DNA, 20 bp, Artificial Sequence
  Synthetic polynucleotide
atgtacacatgcccaaagat

SEQ ID NO: 8224 - DNA, 19 bp, Artificial Sequence
  Synthetic polynucleotide
gtaaaggtggctgagaagg

SEQ ID NO: 8225 - DNA, 20 bp, Artificial Sequence
  Synthetic polynucleotide
taaaaggaggaaaggagcac

SEQ ID NO: 8226 - DNA, 19 bp, Artificial Sequence
  Synthetic polynucleotide
agcaataagaccgaccttg

SEQ ID NO: 8227 - DNA, 20 bp, Artificial Sequence
  Synthetic polynucleotide
gaaaacagttagctgccaaa

SEQ ID NO: 8228 - DNA, 20 bp, Artificial Sequence
  Synthetic polynucleotide
caaacaacccgactaggtaa

SEQ ID NO: 8229 - DNA, 20 bp, Artificial Sequence
  Synthetic polynucleotide
atggttgagctcatggaaat

SEQ ID NO: 8230 - DNA, 20 bp, Artificial Sequence
  Synthetic polynucleotide
gtttacagccagagttttcg

SEQ ID NO: 8231 - DNA, 20 bp, Artificial Sequence
  Synthetic polynucleotide
aggattacgacgattgtctg

SEQ ID NO: 8232 - DNA, 20 bp, Artificial Sequence
  Synthetic polynucleotide
caaggccagatttacgaaac

SEQ ID NO: 8233 - DNA, 20 bp, Artificial Sequence
  Synthetic polynucleotide
atgggtaaaacagcggtatt

SEQ ID NO: 8234 - DNA, 20 bp, Artificial Sequence
  Synthetic polynucleotide
ctcgatatccataccacgac

SEQ ID NO: 8235 - DNA, 20 bp, Artificial Sequence
  Synthetic polynucleotide
gcttgacactacccaaacta

SEQ ID NO: 8236 - DNA, 20 bp, Artificial Sequence
  Synthetic polynucleotide
ctctccaaacctatgcaagt

SEQ ID NO: 8237 - DNA, 20 bp, Artificial Sequence
  Synthetic polynucleotide
cggcaattaaaatccgacaa

SEQ ID NO: 8238 - DNA, 20 bp, Artificial Sequence
  Synthetic polynucleotide
aggttgagcgtttactgatt

SEQ ID NO: 8239 - DNA, 20 bp, Artificial Sequence
  Synthetic polynucleotide
ggctaacacgaaactaggaa

SEQ ID NO: 8240 - DNA, 20 bp, Artificial Sequence
  Synthetic polynucleotide
ccttcgaggacataaccatc

SEQ ID NO: 8241 - DNA, 20 bp, Artificial Sequence
  Synthetic polynucleotide
actgaaaatgctcaaacacg

SEQ ID NO: 8242 - DNA, 20 bp, Artificial Sequence
  Synthetic polynucleotide
gggatcctgtttaccaacat

SEQ ID NO: 8243 - DNA, 20 bp, Artificial Sequence
  Synthetic polynucleotide
tggtcaaacccatggataag

SEQ ID NO: 8244 - DNA, 20 bp, Artificial Sequence
  Synthetic polynucleotide
agaatatccaatcgggcttc

SEQ ID NO: 8245 - DNA, 20 bp, Artificial Sequence
  Synthetic polynucleotide
gtctgctttcgatttgcaaa

SEQ ID NO: 8246 - DNA, 20 bp, Artificial Sequence
  Synthetic polynucleotide
aagtcatccaatttttcgcc

SEQ ID NO: 8247 - DNA, 20 bp, Artificial Sequence
  Synthetic polynucleotide
tggaatatgccattgaagct

SEQ ID NO: 8248 - DNA, 20 bp, Artificial Sequence
  Synthetic polynucleotide
atatcctttggcgtcattgt

SEQ ID NO: 8249 - DNA, 20 bp, Artificial Sequence
  Synthetic polynucleotide
caattagttgggctatccga

SEQ ID NO: 8250 - DNA, 20 bp, Artificial Sequence
  Synthetic polynucleotide
taacgtgtatccaagcacaa

SEQ ID NO: 8251 - DNA, 20 bp, Artificial Sequence
  Synthetic polynucleotide
gccgatacatacaagaccat

SEQ ID NO: 8252 - DNA, 20 bp, Artificial Sequence
  Synthetic polynucleotide
tcggtcctttgataacgatc

SEQ ID NO: 8253 - DNA, 20 bp, Artificial Sequence
  Synthetic polynucleotide
ggaaccgaatggaaacctat

SEQ ID NO: 8254 - DNA, 20 bp, Artificial Sequence
  Synthetic polynucleotide
aatcttcacaccttcatccg

SEQ ID NO: 8255 - DNA, 20 bp, Artificial Sequence
  Synthetic polynucleotide
gcagaacaatttaacggagg

SEQ ID NO: 8256 - DNA, 20 bp, Artificial Sequence
  Synthetic polynucleotide
cagaaacgtaacttccaacg

SEQ ID NO: 8257 - DNA, 20 bp, Artificial Sequence
  Synthetic polynucleotide
gaagacggtgaagctgatat

SEQ ID NO: 8258 - DNA, 20 bp, Artificial Sequence
  Synthetic polynucleotide
tacgtcagtgtgaatcgtac

SEQ ID NO: 8259 - DNA, 20 bp, Artificial Sequence
  Synthetic polynucleotide
atgacggtcacaaattctca

SEQ ID NO: 8260 - DNA, 20 bp, Artificial Sequence
  Synthetic polynucleotide
ctacaaatcgtccatcgtct

SEQ ID NO: 8261 - DNA, 20 bp, Artificial Sequence
  Synthetic polynucleotide
aagcaatttacccaaagcac

SEQ ID NO: 8262 - DNA, 20 bp, Artificial Sequence
  Synthetic polynucleotide
gagccatttcgtaggttttg

SEQ ID NO: 8263 - DNA, 20 bp, Artificial Sequence
  Synthetic polynucleotide
ttggagaaattgctcgagaa

SEQ ID NO: 8264 - DNA, 20 bp, Artificial Sequence
  Synthetic polynucleotide
tgaaatctgccttcttaccc

SEQ ID NO: 8265 - DNA, 20 bp, Artificial Sequence
  Synthetic polynucleotide
gatcaaatagatgcggaggt

SEQ ID NO: 8266 - DNA, 20 bp, Artificial Sequence
  Synthetic polynucleotide
aaaagccgtgtgtaactttg

SEQ ID NO: 8267 - DNA, 20 bp, Artificial Sequence
  Synthetic polynucleotide
atttagtgccaagtctttgc

SEQ ID NO: 8268 - DNA, 20 bp, Artificial Sequence
  Synthetic polynucleotide
caccgatctcaagctattga

SEQ ID NO: 8269 - DNA, 20 bp, Artificial Sequence
  Synthetic polynucleotide
ttcaccaattgctacgtgta

SEQ ID NO: 8270 - DNA, 20 bp, Artificial Sequence
  Synthetic polynucleotide
atcgaccggttgatagaaag

SEQ ID NO: 8271 - DNA, 20 bp, Artificial Sequence
  Synthetic polynucleotide
caatttcgttcatcagcagg

SEQ ID NO: 8272 - DNA, 20 bp, Artificial Sequence
  Synthetic polynucleotide
ctagacaaatcggtgttgga

SEQ ID NO: 8273 - DNA, 20 bp, Artificial Sequence
  Synthetic polynucleotide
cgaggaagaggaagaagatg

SEQ ID NO: 8274 - DNA, 20 bp, Artificial Sequence
  Synthetic polynucleotide
tcggctcatacacttcaaaa

SEQ ID NO: 8275 - DNA, 20 bp, Artificial Sequence
  Synthetic polynucleotide
taaagatgccgggaaaatca

SEQ ID NO: 8276 - DNA, 20 bp, Artificial Sequence
  Synthetic polynucleotide
tactgccactttcttccttc

SEQ ID NO: 8277 - DNA, 20 bp, Artificial Sequence
  Synthetic polynucleotide
tgaactgacgtttcaagcta

SEQ ID NO: 8278 - DNA, 20 bp, Artificial Sequence
  Synthetic polynucleotide
cccttccacttagataggga

SEQ ID NO: 8279 - DNA, 20 bp, Artificial Sequence
  Synthetic polynucleotide
ctatggagctgaagtgtctc

SEQ ID NO: 8280 - DNA, 20 bp, Artificial Sequence
  Synthetic polynucleotide
taagtacgttcttgcaagct

SEQ ID NO: 8281 - DNA, 20 bp, Artificial Sequence
  Synthetic polynucleotide
tagaaaccatcgatctgcag

SEQ ID NO: 8282 - DNA, 20 bp, Artificial Sequence
  Synthetic polynucleotide
gggattaaacataggaggcc

SEQ ID NO: 8283 - DNA, 20 bp, Artificial Sequence
  Synthetic polynucleotide
taacctgcgaaaccataacc

SEQ ID NO: 8284 - DNA, 20 bp, Artificial Sequence
  Synthetic polynucleotide
gctcgtagaattgcagactt

SEQ ID NO: 8285 - DNA, 20 bp, Artificial Sequence
  Synthetic polynucleotide
caagtcggagccaatttaac

SEQ ID NO: 8286 - DNA, 20 bp, Artificial Sequence
  Synthetic polynucleotide
tatggctactgaactaacgc

SEQ ID NO: 8287 - DNA, 20 bp, Artificial Sequence
  Synthetic polynucleotide
ggtcttcatcctctctctct

SEQ ID NO: 8288 - DNA, 20 bp, Artificial Sequence
  Synthetic polynucleotide
ccacttaagatcccactagc

SEQ ID NO: 8289 - DNA, 20 bp, Artificial Sequence
  Synthetic polynucleotide
cgttggtaatcctcgaagat

SEQ ID NO: 8290 - DNA, 20 bp, Artificial Sequence
  Synthetic polynucleotide
tcaatatgaccaacacgtgt

SEQ ID NO: 8291 - DNA, 20 bp, Artificial Sequence
  Synthetic polynucleotide
ggccatcaaaaacatcaaca

SEQ ID NO: 8292 - DNA, 20 bp, Artificial Sequence
  Synthetic polynucleotide
gcctacgatttggattttgg

SEQ ID NO: 8293 - DNA, 20 bp, Artificial Sequence
  Synthetic polynucleotide
gaaaatggcggttagattgg

SEQ ID NO: 8294 - DNA, 20 bp, Artificial Sequence
  Synthetic polynucleotide
gatcacttgtatgccgtagt

SEQ ID NO: 8295 - DNA, 20 bp, Artificial Sequence
  Synthetic polynucleotide
cgaaatcgacaagcacaaaa

SEQ ID NO: 8296 - DNA, 20 bp, Artificial Sequence
  Synthetic polynucleotide
ttcttctcctcaacaaagcc

SEQ ID NO: 8297 - DNA, 20 bp, Artificial Sequence
  Synthetic polynucleotide
aaaaccactttcgtcaaacg

SEQ ID NO: 8298 - DNA, 20 bp, Artificial Sequence
  Synthetic polynucleotide
ctggggatccatttgaactt

SEQ ID NO: 8299 - DNA, 20 bp, Artificial Sequence
  Synthetic polynucleotide
cgtgatgaaatacggcaaaa

SEQ ID NO: 8300 - DNA, 20 bp, Artificial Sequence
  Synthetic polynucleotide
gtcctttttccgttctctct

SEQ ID NO: 8301 - DNA, 20 bp, Artificial Sequence
  Synthetic polynucleotide
atgtggctcatccagataag

SEQ ID NO: 8302 - DNA, 20 bp, Artificial Sequence
  Synthetic polynucleotide
tcttcttactggtttcctgc

SEQ ID NO: 8303 - DNA, 20 bp, Artificial Sequence
  Synthetic polynucleotide
gaaagctggtaaattcaccg

SEQ ID NO: 8304 - DNA, 20 bp, Artificial Sequence
  Synthetic polynucleotide
catcactttacccatcacca

SEQ ID NO: 8305 - DNA, 20 bp, Artificial Sequence
  Synthetic polynucleotide
agatggtaagctgaaacctg

SEQ ID NO: 8306 - DNA, 20 bp, Artificial Sequence
  Synthetic polynucleotide
ttcttgtccttcatcttccg

SEQ ID NO: 8307 - DNA, 20 bp, Artificial Sequence
  Synthetic polynucleotide
gatccatcgataacaaggct

SEQ ID NO: 8308 - DNA, 20 bp, Artificial Sequence
  Synthetic polynucleotide
attactttggccgaagtgat

SEQ ID NO: 8309 - DNA, 20 bp, Artificial Sequence
  Synthetic polynucleotide
ttgttgaattgagcaccaac

SEQ ID NO: 8310 - DNA, 20 bp, Artificial Sequence
  Synthetic polynucleotide
atccacaccatactagctct

SEQ ID NO: 8311 - DNA, 20 bp, Artificial Sequence
  Synthetic polynucleotide
gaggagaagtaggagctaca

SEQ ID NO: 8312 - DNA, 20 bp, Artificial Sequence
  Synthetic polynucleotide
ctacagattgagctgtaccc

SEQ ID NO: 8313 - DNA, 20 bp, Artificial Sequence
  Synthetic polynucleotide
tatcatatcgtgccaagcaa

SEQ ID NO: 8314 - DNA, 20 bp, Artificial Sequence
  Synthetic polynucleotide
atcgtcgagcgttttataca

SEQ ID NO: 8315 - DNA, 20 bp, Artificial Sequence
  Synthetic polynucleotide
gaataacgacgaccttctga

SEQ ID NO: 8316 - DNA, 20 bp, Artificial Sequence
  Synthetic polynucleotide
atccatttttgtcctggtga

SEQ ID NO: 8317 - DNA, 20 bp, Artificial Sequence
  Synthetic polynucleotide
atcccttactccattaccga

SEQ ID NO: 8318 - DNA, 20 bp, Artificial Sequence
  Synthetic polynucleotide
ggtcgataccaaatctcgaa

SEQ ID NO: 8319 - DNA, 20 bp, Artificial Sequence
  Synthetic polynucleotide
aaaaatccttggctccgtag

SEQ ID NO: 8320 - DNA, 20 bp, Artificial Sequence
  Synthetic polynucleotide
tccttcttggcttctttctt

SEQ ID NO: 8321 - DNA, 20 bp, Artificial Sequence
  Synthetic polynucleotide
aacagagctgacgaagattt

SEQ ID NO: 8322 - DNA, 20 bp, Artificial Sequence
  Synthetic polynucleotide
catcttccacacaacaatcg

SEQ ID NO: 8323 - DNA, 20 bp, Artificial Sequence
  Synthetic polynucleotide
agcagcactactacaatagc

SEQ ID NO: 8324 - DNA, 20 bp, Artificial Sequence
  Synthetic polynucleotide
atgagaaacaatttgtgccg

SEQ ID NO: 8325 - DNA, 20 bp, Artificial Sequence
  Synthetic polynucleotide
tttaggactggataacgctg

SEQ ID NO: 8326 - DNA, 20 bp, Artificial Sequence
  Synthetic polynucleotide
tcagaatggagcacatgaaa

SEQ ID NO: 8327 - DNA, 24 bp, Artificial Sequence
  Synthetic polynucleotide
actaatattaacgagcaatttcga

SEQ ID NO: 8328 - DNA, 20 bp, Artificial Sequence
  Synthetic polynucleotide
ccgtatccaattgcgaaaat

SEQ ID NO: 8329 - DNA, 20 bp, Artificial Sequence
  Synthetic polynucleotide
aaggatttctgcgggttaat

SEQ ID NO: 8330 - DNA, 20 bp, Artificial Sequence
  Synthetic polynucleotide
ttctgctcctttttgatcga

SEQ ID NO: 8331 - DNA, 20 bp, Artificial Sequence
  Synthetic polynucleotide
tcgcaaataaaggctatcga

SEQ ID NO: 8332 - DNA, 20 bp, Artificial Sequence
  Synthetic polynucleotide
atactgaggaagctctggat

SEQ ID NO: 8333 - DNA, 20 bp, Artificial Sequence
  Synthetic polynucleotide
actcctttgcaaagaggtag

SEQ ID NO: 8334 - DNA, 20 bp, Artificial Sequence
  Synthetic polynucleotide
atactgcaacgtgagagatc

SEQ ID NO: 8335 - DNA, 20 bp, Artificial Sequence
  Synthetic polynucleotide
acgatttggatgacagttca

SEQ ID NO: 8336 - DNA, 20 bp, Artificial Sequence
  Synthetic polynucleotide
gtttgccgtaatcgaacaat

SEQ ID NO: 8337 - DNA, 20 bp, Artificial Sequence
  Synthetic polynucleotide
tctgttgaaattacggctga

SEQ ID NO: 8338 - DNA, 20 bp, Artificial Sequence
  Synthetic polynucleotide
cgtatcgattttgcaccaaa

SEQ ID NO: 8339 - DNA, 20 bp, Artificial Sequence
  Synthetic polynucleotide
tgtatgatttgggcggtaaa

SEQ ID NO: 8340 - DNA, 20 bp, Artificial Sequence
  Synthetic polynucleotide
tctccttacagatcctcgtt

SEQ ID NO: 8341 - DNA, 20 bp, Artificial Sequence
  Synthetic polynucleotide
tcttcgactcttcagaggat

SEQ ID NO: 8342 - DNA, 20 bp, Artificial Sequence
  Synthetic polynucleotide
aattctgcgcaaagtttcaa

SEQ ID NO: 8343 - DNA, 20 bp, Artificial Sequence
  Synthetic polynucleotide
cttacactacgggcgaattt

SEQ ID NO: 8344 - DNA, 20 bp, Artificial Sequence
  Synthetic polynucleotide
aaatttcctcgagtccttgg

SEQ ID NO: 8345 - DNA, 20 bp, Artificial Sequence
  Synthetic polynucleotide
atgcagcattttcaaaagct

SEQ ID NO: 8346 - DNA, 20 bp, Artificial Sequence
  Synthetic polynucleotide
atacggcgcataacctattt

SEQ ID NO: 8347 - DNA, 20 bp, Artificial Sequence
  Synthetic polynucleotide
tcttaggcacctcgttagta

SEQ ID NO: 8348 - DNA, 20 bp, Artificial Sequence
  Synthetic polynucleotide
tggccacattaatcacatga

SEQ ID NO: 8349 - DNA, 20 bp, Artificial Sequence
  Synthetic polynucleotide
tgctctccgttgatgttaaa

SEQ ID NO: 8350 - DNA, 20 bp, Artificial Sequence
  Synthetic polynucleotide
atcaggtcgttctaattcgg

SEQ ID NO: 8351 - DNA, 20 bp, Artificial Sequence
  Synthetic polynucleotide
cgagtgcatagaggaattga

SEQ ID NO: 8352 - DNA, 20 bp, Artificial Sequence
  Synthetic polynucleotide
gaagtttcggttgtttggtt

SEQ ID NO: 8353 - DNA, 20 bp, Artificial Sequence
  Synthetic polynucleotide
cagcaacaacaaagtctacc

SEQ ID NO: 8354 - DNA, 20 bp, Artificial Sequence
  Synthetic polynucleotide
actgtgagtcagaaccaatc

SEQ ID NO: 8355 - DNA, 20 bp, Artificial Sequence
  Synthetic polynucleotide
aagtcccttttcaaagctca

SEQ ID NO: 8356 - DNA, 20 bp, Artificial Sequence
  Synthetic polynucleotide
gccgatgacaattgactttg

SEQ ID NO: 8357 - DNA, 20 bp, Artificial Sequence
  Synthetic polynucleotide
cttttgtgaacttcctgagc

SEQ ID NO: 8358 - DNA, 20 bp, Artificial Sequence
  Synthetic polynucleotide
gctccggattgattttcttg

SEQ ID NO: 8359 - DNA, 20 bp, Artificial Sequence
  Synthetic polynucleotide
gcgatagagaaaggtggatt

SEQ ID NO: 8360 - DNA, 20 bp, Artificial Sequence
  Synthetic polynucleotide
tgcccttgttttgtctactt

SEQ ID NO: 8361 - DNA, 20 bp, Artificial Sequence
  Synthetic polynucleotide
aacaagcttggcaaacttac

SEQ ID NO: 8362 - DNA, 20 bp, Artificial Sequence
  Synthetic polynucleotide
tcctatggacatgcctagaa

SEQ ID NO: 8363 - DNA, 20 bp, Artificial Sequence
  Synthetic polynucleotide
gacgatcatatggaaggctt

SEQ ID NO: 8364 - DNA, 20 bp, Artificial Sequence
  Synthetic polynucleotide
gtatcggttgagttcgtgta

SEQ ID NO: 8365 - DNA, 20 bp, Artificial Sequence
  Synthetic polynucleotide
gcaggacaagttattaaggc

SEQ ID NO: 8366 - DNA, 20 bp, Artificial Sequence
  Synthetic polynucleotide
ccggagtcaaaatcagttct

SEQ ID NO: 8367 - DNA, 20 bp, Artificial Sequence
  Synthetic polynucleotide
aatttaaccaccatcggtca

SEQ ID NO: 8368 - DNA, 20 bp, Artificial Sequence
  Synthetic polynucleotide
ccatctccgtattcaatcgt

SEQ ID NO: 8369 - DNA, 20 bp, Artificial Sequence
  Synthetic polynucleotide
tcatcttctgttatcagccg

SEQ ID NO: 8370 - DNA, 20 bp, Artificial Sequence
  Synthetic polynucleotide
tgtaaactttaccatcggca

SEQ ID NO: 8371 - DNA, 20 bp, Artificial Sequence
  Synthetic polynucleotide
caaccccttattcgaaaagc

SEQ ID NO: 8372 - DNA, 20 bp, Artificial Sequence
  Synthetic polynucleotide
tgatttcgaaccgaggatac

SEQ ID NO: 8373 - DNA, 20 bp, Artificial Sequence
  Synthetic polynucleotide
cttttcgaaaagcacatcga

SEQ ID NO: 8374 - DNA, 20 bp, Artificial Sequence
  Synthetic polynucleotide
ttagagaagaaagcacccac

SEQ ID NO: 8375 - DNA, 20 bp, Artificial Sequence
  Synthetic polynucleotide
accaaggctaacttcgattt

SEQ ID NO: 8376 - DNA, 20 bp, Artificial Sequence
  Synthetic polynucleotide
gtatctctcacaatgacgct

SEQ ID NO: 8377 - DNA, 20 bp, Artificial Sequence
  Synthetic polynucleotide
catcgaataccttacgtggt

SEQ ID NO: 8378 - DNA, 20 bp, Artificial Sequence
  Synthetic polynucleotide
attagcgaaatgagccgtat

SEQ ID NO: 8379 - DNA, 20 bp, Artificial Sequence
  Synthetic polynucleotide
gtttatcggcaccttcaaag

SEQ ID NO: 8380 - DNA, 19 bp, Artificial Sequence
  Synthetic polynucleotide
ttaataaggtctcggcggt

SEQ ID NO: 8381 - DNA, 20 bp, Artificial Sequence
  Synthetic polynucleotide
acctgcgaatagtgactcta

SEQ ID NO: 8382 - DNA, 20 bp, Artificial Sequence
  Synthetic polynucleotide
ttttcagataggggaaaggc

SEQ ID NO: 8383 - DNA, 20 bp, Artificial Sequence
  Synthetic polynucleotide
acgatttggatgacagttca

SEQ ID NO: 8384 - DNA, 20 bp, Artificial Sequence
  Synthetic polynucleotide
gtttgccgtaatcgaacaat

SEQ ID NO: 8385 - DNA, 20 bp, Artificial Sequence
  Synthetic polynucleotide
aagaagaagtcgatgctgtt

SEQ ID NO: 8386 - DNA, 20 bp, Artificial Sequence
  Synthetic polynucleotide
tcttcctccgagactacaat

SEQ ID NO: 8387 - DNA, 20 bp, Artificial Sequence
  Synthetic polynucleotide
gcgaagtaggccaagtatta

SEQ ID NO: 8388 - DNA, 20 bp, Artificial Sequence
  Synthetic polynucleotide
catcttgaccggtaaaaacg

SEQ ID NO: 8389 - DNA, 20 bp, Artificial Sequence
  Synthetic polynucleotide
gaagcaactgacagaagaga

SEQ ID NO: 8390 - DNA, 20 bp, Artificial Sequence
  Synthetic polynucleotide
cctattggtcgccataatca

SEQ ID NO: 8391 - DNA, 20 bp, Artificial Sequence
  Synthetic polynucleotide
gtatcaagtcgagtatgcca

SEQ ID NO: 8392 - DNA, 20 bp, Artificial Sequence
  Synthetic polynucleotide
agttcttccacttctttgct

SEQ ID NO: 8393 - DNA, 20 bp, Artificial Sequence
  Synthetic polynucleotide
tacttcacatttgctccgaa

SEQ ID NO: 8394 - DNA, 20 bp, Artificial Sequence
  Synthetic polynucleotide
ttaccagcttgaccaactac

SEQ ID NO: 8395 - DNA, 20 bp, Artificial Sequence
  Synthetic polynucleotide
acataaacgtccttcaagct

SEQ ID NO: 8396 - DNA, 20 bp, Artificial Sequence
  Synthetic polynucleotide
taataattggctgcagtggt

SEQ ID NO: 8397 - DNA, 20 bp, Artificial Sequence
  Synthetic polynucleotide
aaagtgagctatgagcacaa

SEQ ID NO: 8398 - DNA, 20 bp, Artificial Sequence
  Synthetic polynucleotide
ggttctccgttgcttttatg

SEQ ID NO: 8399 - DNA, 19 bp, Artificial Sequence
  Synthetic polynucleotide
gtcgattttggcgtacaac

SEQ ID NO: 8400 - DNA, 20 bp, Artificial Sequence
  Synthetic polynucleotide
tcgaaagcgttaatcaaagc

SEQ ID NO: 8401 - DNA, 20 bp, Artificial Sequence
  Synthetic polynucleotide
tgctcgaaaaaggagatgaa

SEQ ID NO: 8402 - DNA, 20 bp, Artificial Sequence
  Synthetic polynucleotide
gatggatttccccttcaact

SEQ ID NO: 8403 - DNA, 20 bp, Artificial Sequence
  Synthetic polynucleotide
cgatgaagcagaaacgaaaa

SEQ ID NO: 8404 - DNA, 20 bp, Artificial Sequence
  Synthetic polynucleotide
tttatcgtgtcgacagtctc

SEQ ID NO: 8405 - DNA, 20 bp, Artificial Sequence
  Synthetic polynucleotide
aagttcagccgattaccaat

SEQ ID NO: 8406 - DNA, 20 bp, Artificial Sequence
  Synthetic polynucleotide
agatccagcttgatgttgag

SEQ ID NO: 8407 - DNA, 20 bp, Artificial Sequence
  Synthetic polynucleotide
ttacggacagcatgttgtta

SEQ ID NO: 8408 - DNA, 20 bp, Artificial Sequence
  Synthetic polynucleotide
aaattgatagcgacaccctt

SEQ ID NO: 8409 - DNA, 20 bp, Artificial Sequence
  Synthetic polynucleotide
tactgtggaagataccgagt

SEQ ID NO: 8410 - DNA, 20 bp, Artificial Sequence
  Synthetic polynucleotide
ttattagccatagcagccag

SEQ ID NO: 8411 - DNA, 20 bp, Artificial Sequence
  Synthetic polynucleotide
atcagtaccgttggttatcg

SEQ ID NO: 8412 - DNA, 20 bp, Artificial Sequence
  Synthetic polynucleotide
accgtttctgtcttctatcg

SEQ ID NO: 8413 - DNA, 20 bp, Artificial Sequence
  Synthetic polynucleotide
cggtgaccataaaaaccatg

SEQ ID NO: 8414 - DNA, 20 bp, Artificial Sequence
  Synthetic polynucleotide
ggcgtgaaatcgtttttgat

SEQ ID NO: 8415 - DNA, 20 bp, Artificial Sequence
  Synthetic polynucleotide
tgtgtgataaggcgaaagaa

SEQ ID NO: 8416 - DNA, 20 bp, Artificial Sequence
  Synthetic polynucleotide
gcctgattgccacatctata

SEQ ID NO: 8417 - DNA, 20 bp, Artificial Sequence
  Synthetic polynucleotide
tattgagaacgtgaaagcca

SEQ ID NO: 8418 - DNA, 20 bp, Artificial Sequence
  Synthetic polynucleotide
ggccttcacgttttcaatag

SEQ ID NO: 8419 - DNA, 20 bp, Artificial Sequence
  Synthetic polynucleotide
cgttcaagaaaaccttctcg

SEQ ID NO: 8420 - DNA, 20 bp, Artificial Sequence
  Synthetic polynucleotide
catcaaccccataccaagaa

SEQ ID NO: 8421 - DNA, 20 bp, Artificial Sequence
  Synthetic polynucleotide
gaaggggacgaatacactac

SEQ ID NO: 8422 - DNA, 20 bp, Artificial Sequence
  Synthetic polynucleotide
ttcggatttcttctgcttga

SEQ ID NO: 8423 - DNA, 20 bp, Artificial Sequence
  Synthetic polynucleotide
atcacttcaattccaggacc

SEQ ID NO: 8424 - DNA, 20 bp, Artificial Sequence
  Synthetic polynucleotide
gattcccgacactatttcga

SEQ ID NO: 8425 - DNA, 20 bp, Artificial Sequence
  Synthetic polynucleotide
gaaaaccgaagtgctaatgg

SEQ ID NO: 8426 - DNA, 20 bp, Artificial Sequence
  Synthetic polynucleotide
tcagcagtctatccagaaga

SEQ ID NO: 8427 - DNA, 20 bp, Artificial Sequence
  Synthetic polynucleotide
ctatcatttgggggctctac

SEQ ID NO: 8428 - DNA, 20 bp, Artificial Sequence
  Synthetic polynucleotide
ggttatcgctcatccattct

SEQ ID NO: 8429 - DNA, 20 bp, Artificial Sequence
  Synthetic polynucleotide
agaagatgatccttcgaacg

SEQ ID NO: 8430 - DNA, 20 bp, Artificial Sequence
  Synthetic polynucleotide
ctcatcaggtaaaaggcctt

SEQ ID NO: 8431 - DNA, 20 bp, Artificial Sequence
  Synthetic polynucleotide
aaaggagtcttggatgtgtc

SEQ ID NO: 8432 - DNA, 20 bp, Artificial Sequence
  Synthetic polynucleotide
ttcctttttaccttcctccg

SEQ ID NO: 8433 - DNA, 20 bp, Artificial Sequence
  Synthetic polynucleotide
agaaatagccagaacccaag

SEQ ID NO: 8434 - DNA, 20 bp, Artificial Sequence
  Synthetic polynucleotide
agttcctcggttctgtttac

SEQ ID NO: 8435 - DNA, 20 bp, Artificial Sequence
  Synthetic polynucleotide
acgccagattaatccttacg

SEQ ID NO: 8436 - DNA, 20 bp, Artificial Sequence
  Synthetic polynucleotide
gcagcggatatgaaaacatc

SEQ ID NO: 8437 - DNA, 20 bp, Artificial Sequence
  Synthetic polynucleotide
aaaataatcatgccgccttc

SEQ ID NO: 8438 - DNA, 20 bp, Artificial Sequence
  Synthetic polynucleotide
tttccttaggcttcgctatc

SEQ ID NO: 8439 - DNA, 20 bp, Artificial Sequence
  Synthetic polynucleotide
ctagagaaaatcgctgagct

SEQ ID NO: 8440 - DNA, 20 bp, Artificial Sequence
  Synthetic polynucleotide
gtaaactcctcttggcttca

SEQ ID NO: 8441 - DNA, 20 bp, Artificial Sequence
  Synthetic polynucleotide
gtgaaaaagtggaatgctgt

SEQ ID NO: 8442 - DNA, 21 bp, Artificial Sequence
  Synthetic polynucleotide
cctgcctagtttttaaccatc

SEQ ID NO: 8443 - DNA, 20 bp, Artificial Sequence
  Synthetic polynucleotide
accttgagctcgaaaattct

SEQ ID NO: 8444 - DNA, 20 bp, Artificial Sequence
  Synthetic polynucleotide
gtctataatctgctgggtgg

SEQ ID NO: 8445 - DNA, 20 bp, Artificial Sequence
  Synthetic polynucleotide
acgtcttcatcaagtcgaat

SEQ ID NO: 8446 - DNA, 20 bp, Artificial Sequence
  Synthetic polynucleotide
ttcaccctcgattaaagcaa

SEQ ID NO: 8447 - DNA, 20 bp, Artificial Sequence
  Synthetic polynucleotide
ttaccgggttcgtacaaatt

SEQ ID NO: 8448 - DNA, 20 bp, Artificial Sequence
  Synthetic polynucleotide
cttcttccattcgtttgctc

SEQ ID NO: 8449 - DNA, 20 bp, Artificial Sequence
  Synthetic polynucleotide
ggcggtttagacgataaagt

SEQ ID NO: 8450 - DNA, 19 bp, Artificial Sequence
  Synthetic polynucleotide
catcatgccggtgattaga

SEQ ID NO: 8451 - DNA, 20 bp, Artificial Sequence
  Synthetic polynucleotide
taaaaggaggaaaggagcac

SEQ ID NO: 8452 - DNA, 19 bp, Artificial Sequence
  Synthetic polynucleotide
agcaataagaccgaccttg

SEQ ID NO: 8453 - DNA, 20 bp, Artificial Sequence
  Synthetic polynucleotide
aaacaattagccacgaaagc

SEQ ID NO: 8454 - DNA, 20 bp, Artificial Sequence
  Synthetic polynucleotide
atcttcaaaaagaccgacca

SEQ ID NO: 8455 - DNA, 20 bp, Artificial Sequence
  Synthetic polynucleotide
gccgttaatataactgcagc

SEQ ID NO: 8456 - DNA, 20 bp, Artificial Sequence
  Synthetic polynucleotide
ttcaactcgacgactttctt

SEQ ID NO: 8457 - DNA, 20 bp, Artificial Sequence
  Synthetic polynucleotide
aaatagtactcgagccgaac

SEQ ID NO: 8458 - DNA, 20 bp, Artificial Sequence
  Synthetic polynucleotide
tacaaccactggtaaatggg

SEQ ID NO: 8459 - DNA, 20 bp, Artificial Sequence
  Synthetic polynucleotide
ggggttaaaggaacatacgt

SEQ ID NO: 8460 - DNA, 20 bp, Artificial Sequence
  Synthetic polynucleotide
aatttcgcttcatcgtcaac

SEQ ID NO: 8461 - DNA, 20 bp, Artificial Sequence
  Synthetic polynucleotide
atcaagccgataagttggtt

SEQ ID NO: 8462 - DNA, 20 bp, Artificial Sequence
  Synthetic polynucleotide
cactctgattgtgcaaatcc

SEQ ID NO: 8463 - DNA, 20 bp, Artificial Sequence
  Synthetic polynucleotide
cggcaattaaaatccgacaa

SEQ ID NO: 8464 - DNA, 20 bp, Artificial Sequence
  Synthetic polynucleotide
aggttgagcgtttactgatt

SEQ ID NO: 8465 - DNA, 20 bp, Artificial Sequence
  Synthetic polynucleotide
taccgtgccctaagattaga

SEQ ID NO: 8466 - DNA, 20 bp, Artificial Sequence
  Synthetic polynucleotide
ccttcgaggacataaccatc

SEQ ID NO: 8467 - DNA, 20 bp, Artificial Sequence
  Synthetic polynucleotide
ctgctgaaaatgctcaaaca

SEQ ID NO: 8468 - DNA, 20 bp, Artificial Sequence
  Synthetic polynucleotide
aattctttgccaattccagc

SEQ ID NO: 8469 - DNA, 20 bp, Artificial Sequence
  Synthetic polynucleotide
cgacattaacgacgttacac

SEQ ID NO: 8470 - DNA, 20 bp, Artificial Sequence
  Synthetic polynucleotide
aagatatccaatcgggcttc

SEQ ID NO: 8471 - DNA, 20 bp, Artificial Sequence
  Synthetic polynucleotide
tgctttcgatttgcaaagtt

SEQ ID NO: 8472 - DNA, 20 bp, Artificial Sequence
  Synthetic polynucleotide
agccctctgatttgtttacc

SEQ ID NO: 8473 - DNA, 20 bp, Artificial Sequence
  Synthetic polynucleotide
tggaatatgccattgaagct

SEQ ID NO: 8474 - DNA, 20 bp, Artificial Sequence
  Synthetic polynucleotide
tgacttctacattggacgag

SEQ ID NO: 8475 - DNA, 20 bp, Artificial Sequence
  Synthetic polynucleotide
gatttgaaggttgggactct

SEQ ID NO: 8476 - DNA, 20 bp, Artificial Sequence
  Synthetic polynucleotide
accgtattgcttcttcttgt

SEQ ID NO: 8477 - DNA, 20 bp, Artificial Sequence
  Synthetic polynucleotide
tgtctggatttctcattgca

SEQ ID NO: 8478 - DNA, 20 bp, Artificial Sequence
  Synthetic polynucleotide
gtacttcagatgagcgtgat

SEQ ID NO: 8479 - DNA, 20 bp, Artificial Sequence
  Synthetic polynucleotide
cgcaacgaatccaataactc

SEQ ID NO: 8480 - DNA, 19 bp, Artificial Sequence
  Synthetic polynucleotide
cgatcttcaccccttcatc

SEQ ID NO: 8481 - DNA, 20 bp, Artificial Sequence
  Synthetic polynucleotide
cctagcagtcgtaaacgtaa

SEQ ID NO: 8482 - DNA, 20 bp, Artificial Sequence
  Synthetic polynucleotide
gggtggtaaattgcaatagc

SEQ ID NO: 8483 - DNA, 20 bp, Artificial Sequence
  Synthetic polynucleotide
cagattaggtcaagaggtcg

SEQ ID NO: 8484 - DNA, 20 bp, Artificial Sequence
  Synthetic polynucleotide
tgaatccattccagtcttgg

SEQ ID NO: 8485 - DNA, 20 bp, Artificial Sequence
  Synthetic polynucleotide
ggccaagaaaactactctca

SEQ ID NO: 8486 - DNA, 20 bp, Artificial Sequence
  Synthetic polynucleotide
caatgtgaatggaaacggag

SEQ ID NO: 8487 - DNA, 20 bp, Artificial Sequence
  Synthetic polynucleotide
tgtacaccgatgctttacaa

SEQ ID NO: 8488 - DNA, 20 bp, Artificial Sequence
  Synthetic polynucleotide
caaacactatcaggacacca

SEQ ID NO: 8489 - DNA, 20 bp, Artificial Sequence
  Synthetic polynucleotide
atacgaatccaggtgtaacg

SEQ ID NO: 8490 - DNA, 20 bp, Artificial Sequence
  Synthetic polynucleotide
ctggtattcctgaagttgct

SEQ ID NO: 8491 - DNA, 20 bp, Artificial Sequence
  Synthetic polynucleotide
ctgagaatccacaccaagaa

SEQ ID NO: 8492 - DNA, 20 bp, Artificial Sequence
  Synthetic polynucleotide
ggacgtaatatagccggatc

SEQ ID NO: 8493 - DNA, 20 bp, Artificial Sequence
  Synthetic polynucleotide
atttagtgccaagtctttgc

SEQ ID NO: 8494 - DNA, 20 bp, Artificial Sequence
  Synthetic polynucleotide
caccgatctcaagctattga

SEQ ID NO: 8495 - DNA, 20 bp, Artificial Sequence
  Synthetic polynucleotide
ctttctatcaaccggtcgat

SEQ ID NO: 8496 - DNA, 20 bp, Artificial Sequence
  Synthetic polynucleotide
gaaagttgtcgtttctcgtc

SEQ ID NO: 8497 - DNA, 20 bp, Artificial Sequence
  Synthetic polynucleotide
caatttcgttcatcagcagg

SEQ ID NO: 8498 - DNA, 20 bp, Artificial Sequence
  Synthetic polynucleotide
gaaagcagattcagtccaga

SEQ ID NO: 8499 - DNA, 20 bp, Artificial Sequence
  Synthetic polynucleotide
tcgagcaagaatcttttgga

SEQ ID NO: 8500 - DNA, 20 bp, Artificial Sequence
  Synthetic polynucleotide
acaccacttggcatcatatt

SEQ ID NO: 8501 - DNA, 20 bp, Artificial Sequence
  Synthetic polynucleotide
tgctcgatgatgtaaaggag

SEQ ID NO: 8502 - DNA, 20 bp, Artificial Sequence
  Synthetic polynucleotide
agctttcctaggcccatata

SEQ ID NO: 8503 - DNA, 20 bp, Artificial Sequence
  Synthetic polynucleotide
tggtatcggcttgttgtaaa

SEQ ID NO: 8504 - DNA, 20 bp, Artificial Sequence
  Synthetic polynucleotide
atttgtacacgtcgttttcg

SEQ ID NO: 8505 - DNA, 20 bp, Artificial Sequence
  Synthetic polynucleotide
ttcaatctgggggttttcaa

SEQ ID NO: 8506 - DNA, 20 bp, Artificial Sequence
  Synthetic polynucleotide
tctatgcagtctaatcccca

SEQ ID NO: 8507 - DNA, 20 bp, Artificial Sequence
  Synthetic polynucleotide
tagaaaccatcgatctgcag

SEQ ID NO: 8508 - DNA, 20 bp, Artificial Sequence
  Synthetic polynucleotide
atgggattaaacatgggagg

SEQ ID NO: 8509 - DNA, 20 bp, Artificial Sequence
  Synthetic polynucleotide
taacctgcgaaaccataacc

SEQ ID NO: 8510 - DNA, 20 bp, Artificial Sequence
  Synthetic polynucleotide
gctcgtagaattgcagactt

SEQ ID NO: 8511 - DNA, 20 bp, Artificial Sequence
  Synthetic polynucleotide
gtttgctcgaacttcttgag

SEQ ID NO: 8512 - DNA, 20 bp, Artificial Sequence
  Synthetic polynucleotide
ctagcgataacttcttgcct

SEQ ID NO: 8513 - DNA, 20 bp, Artificial Sequence
  Synthetic polynucleotide
acgaaaatgatcggatgact

SEQ ID NO: 8514 - DNA, 20 bp, Artificial Sequence
  Synthetic polynucleotide
atgtaattgtggcctccttt

SEQ ID NO: 8515 - DNA, 20 bp, Artificial Sequence
  Synthetic polynucleotide
cgttggtaatcctcgaagat

SEQ ID NO: 8516 - DNA, 20 bp, Artificial Sequence
  Synthetic polynucleotide
tcaatatgaccaacacgtgt

SEQ ID NO: 8517 - DNA, 20 bp, Artificial Sequence
  Synthetic polynucleotide
ggaaacaatgggcatcaaaa

SEQ ID NO: 8518 - DNA, 20 bp, Artificial Sequence
  Synthetic polynucleotide
tgtcgatttttccggtgtat

SEQ ID NO: 8519 - DNA, 20 bp, Artificial Sequence
  Synthetic polynucleotide
actacggcatacaagtgatc

SEQ ID NO: 8520 - DNA, 20 bp, Artificial Sequence
  Synthetic polynucleotide
cctccatggctactatgaac

SEQ ID NO: 8521 - DNA, 20 bp, Artificial Sequence
  Synthetic polynucleotide
cgaaatcgacaagcacaaaa

SEQ ID NO: 8522 - DNA, 18 bp, Artificial Sequence
  Synthetic polynucleotide
aacaaggcctgttcgatg

SEQ ID NO: 8523 - DNA, 20 bp, Artificial Sequence
  Synthetic polynucleotide
gttcgagaaaaagtacgtcg

SEQ ID NO: 8524 - DNA, 20 bp, Artificial Sequence
  Synthetic polynucleotide
gttttctagctgtttctgcc

SEQ ID NO: 8525 - DNA, 20 bp, Artificial Sequence
  Synthetic polynucleotide
gagtaggaggaacatggaac

SEQ ID NO: 8526 - DNA, 20 bp, Artificial Sequence
  Synthetic polynucleotide
aaataaccgagccagtagtg

SEQ ID NO: 8527 - DNA, 20 bp, Artificial Sequence
  Synthetic polynucleotide
cgtgatgaaatacggcaaaa

SEQ ID NO: 8528 - DNA, 20 bp, Artificial Sequence
  Synthetic polynucleotide
gtcctttttccgttctctct

SEQ ID NO: 8529 - DNA, 20 bp, Artificial Sequence
  Synthetic polynucleotide
atgtggctcatccagataag

SEQ ID NO: 8530 - DNA, 20 bp, Artificial Sequence
  Synthetic polynucleotide
tcttcttactggtttcctgc

SEQ ID NO: 8531 - DNA, 20 bp, Artificial Sequence
  Synthetic polynucleotide
aagagatcgtcgtttctcag

SEQ ID NO: 8532 - DNA, 20 bp, Artificial Sequence
  Synthetic polynucleotide
gtttcgcattgtttcaggaa

SEQ ID NO: 8533 - DNA, 20 bp, Artificial Sequence
  Synthetic polynucleotide
gtaagctgaaacctgggtta

SEQ ID NO: 8534 - DNA, 20 bp, Artificial Sequence
  Synthetic polynucleotide
accgaatttcttgtccttca

SEQ ID NO: 8535 - DNA, 20 bp, Artificial Sequence
  Synthetic polynucleotide
cagattaggtcaagaggtcg

SEQ ID NO: 8536 - DNA, 20 bp, Artificial Sequence
  Synthetic polynucleotide
tgaatccattccagtcttgg

SEQ ID NO: 8537 - DNA, 20 bp, Artificial Sequence
  Synthetic polynucleotide
ccaaagtcatgatggaggaa

SEQ ID NO: 8538 - DNA, 20 bp, Artificial Sequence
  Synthetic polynucleotide
ttgtcgatctccaacaacat

SEQ ID NO: 8539 - DNA, 20 bp, Artificial Sequence
  Synthetic polynucleotide
acccgatatacgtgaaactg

SEQ ID NO: 8540 - DNA, 20 bp, Artificial Sequence
  Synthetic polynucleotide
ggtaacgtcttcctgatacc

SEQ ID NO: 8541 - DNA, 20 bp, Artificial Sequence
  Synthetic polynucleotide
gaggagaagtaggagctaca

SEQ ID NO: 8542 - DNA, 20 bp, Artificial Sequence
  Synthetic polynucleotide
ctacagattgagctgtaccc

SEQ ID NO: 8543 - DNA, 20 bp, Artificial Sequence
  Synthetic polynucleotide
gcaaatggaggaggaactta

SEQ ID NO: 8544 - DNA, 20 bp, Artificial Sequence
  Synthetic polynucleotide
cattctcacccatttaccca

SEQ ID NO: 8545 - DNA, 20 bp, Artificial Sequence
  Synthetic polynucleotide
ggacggtgaagaagtgataa

SEQ ID NO: 8546 - DNA, 20 bp, Artificial Sequence
  Synthetic polynucleotide
tcagaaatcgcagtttggta

SEQ ID NO: 8547 - DNA, 20 bp, Artificial Sequence
  Synthetic polynucleotide
gaccgaatcgataaaggtca

SEQ ID NO: 8548 - DNA, 20 bp, Artificial Sequence
  Synthetic polynucleotide
tcgtccactttaaccgattt

SEQ ID NO: 8549 - DNA, 20 bp, Artificial Sequence
  Synthetic polynucleotide
tggttctgtaggagttgaag

SEQ ID NO: 8550 - DNA, 20 bp, Artificial Sequence
  Synthetic polynucleotide
caaaaagaccaaagcccatg

SEQ ID NO: 8551 - DNA, 20 bp, Artificial Sequence
  Synthetic polynucleotide
atagacgactttttggctgt

SEQ ID NO: 8552 - DNA, 20 bp, Artificial Sequence
  Synthetic polynucleotide
gagcttgtccaatttagtgc

SEQ ID NO: 8553 - DNA, 20 bp, Artificial Sequence
  Synthetic polynucleotide
ttgtttggatcaactgcaac

SEQ ID NO: 8554 - DNA, 20 bp, Artificial Sequence
  Synthetic polynucleotide
gcgtcaaaggattcgaaatt

SEQ ID NO: 8555 - DNA, 20 bp, Artificial Sequence
  Synthetic polynucleotide
actgctctttttaggactgg

SEQ ID NO: 8556 - DNA, 20 bp, Artificial Sequence
  Synthetic polynucleotide
gaacacatgaaaagctcgag

SEQ ID NO: 8557 - DNA, 20 bp, Artificial Sequence
  Synthetic polynucleotide
agcaaaatccacgcaattac

SEQ ID NO: 8558 - DNA, 20 bp, Artificial Sequence
  Synthetic polynucleotide
tggtaaaatcccactgtgaa

SEQ ID NO: 8559 - DNA, 20 bp, Artificial Sequence
  Synthetic polynucleotide
tctggaacggaaacctattg

SEQ ID NO: 8560 - DNA, 20 bp, Artificial Sequence
  Synthetic polynucleotide
cctcgaacgaatactggaat

SEQ ID NO: 8561 - DNA, 20 bp, Artificial Sequence
  Synthetic polynucleotide
acgatcatcgacaagcatta

SEQ ID NO: 8562 - DNA, 20 bp, Artificial Sequence
  Synthetic polynucleotide
atcgtttcttttcgttgtcg

SEQ ID NO: 8563 - DNA, 20 bp, Artificial Sequence
  Synthetic polynucleotide
caaagaagtaggctggaagt

SEQ ID NO: 8564 - DNA, 20 bp, Artificial Sequence
  Synthetic polynucleotide
tactgcaatgtgagagatcg

SEQ ID NO: 8565 - DNA, 20 bp, Artificial Sequence
  Synthetic polynucleotide
agagaaatggtccagtgttc

SEQ ID NO: 8566 - DNA, 20 bp, Artificial Sequence
  Synthetic polynucleotide
agtctaagcatctccatcct

SEQ ID NO: 8567 - DNA, 20 bp, Artificial Sequence
  Synthetic polynucleotide
tttgatgatgacttggacgt

SEQ ID NO: 8568 - DNA, 20 bp, Artificial Sequence
  Synthetic polynucleotide
ttgtatccatttcccctgtg

SEQ ID NO: 8569 - DNA, 20 bp, Artificial Sequence
  Synthetic polynucleotide
atgagtaaaaccgaggcatt

SEQ ID NO: 8570 - DNA, 20 bp, Artificial Sequence
  Synthetic polynucleotide
gatttgtaagttgtgcctcg

SEQ ID NO: 8571 - DNA, 20 bp, Artificial Sequence
  Synthetic polynucleotide
ttcgactcttcagaggatct

SEQ ID NO: 8572 - DNA, 20 bp, Artificial Sequence
  Synthetic polynucleotide
aattcagcgcaaagtttcaa

SEQ ID NO: 8573 - DNA, 20 bp, Artificial Sequence
  Synthetic polynucleotide
gaactcgccttatgggatac

SEQ ID NO: 8574 - DNA, 20 bp, Artificial Sequence
  Synthetic polynucleotide
tctcaaacacttctctgacg

SEQ ID NO: 8575 - DNA, 20 bp, Artificial Sequence
  Synthetic polynucleotide
agatgacacggacaattcaa

SEQ ID NO: 8576 - DNA, 20 bp, Artificial Sequence
  Synthetic polynucleotide
gctaagtaagacagcctctc

SEQ ID NO: 8577 - DNA, 20 bp, Artificial Sequence
  Synthetic polynucleotide
gcgattttaaagaaagccga

SEQ ID NO: 8578 - DNA, 20 bp, Artificial Sequence
  Synthetic polynucleotide
tcatgtgttccaacgaatct

SEQ ID NO: 8579 - DNA, 20 bp, Artificial Sequence
  Synthetic polynucleotide
gcagaggatcgtggaaatat

SEQ ID NO: 8580 - DNA, 20 bp, Artificial Sequence
  Synthetic polynucleotide
ttgcaaacgatctttatggc

SEQ ID NO: 8581 - DNA, 20 bp, Artificial Sequence
  Synthetic polynucleotide
atcacgttcgaatgcataga

SEQ ID NO: 8582 - DNA, 20 bp, Artificial Sequence
  Synthetic polynucleotide
aagtttcggctgtttggtta

SEQ ID NO: 8583 - DNA, 20 bp, Artificial Sequence
  Synthetic polynucleotide
gccatacaacaacaacaaca

SEQ ID NO: 8584 - DNA, 20 bp, Artificial Sequence
  Synthetic polynucleotide
gactttagcaccagtcagaa

SEQ ID NO: 8585 - DNA, 20 bp, Artificial Sequence
  Synthetic polynucleotide
gctgtcatactcatctgtca

SEQ ID NO: 8586 - DNA, 20 bp, Artificial Sequence
  Synthetic polynucleotide
cgatgacaattgaccttgtg

SEQ ID NO: 8587 - DNA, 20 bp, Artificial Sequence
  Synthetic polynucleotide
agaaatacgagaagtccagc

SEQ ID NO: 8588 - DNA, 20 bp, Artificial Sequence
  Synthetic polynucleotide
acatcatcttctcgaccatg

SEQ ID NO: 8589 - DNA, 20 bp, Artificial Sequence
  Synthetic polynucleotide
gcgatagagaaaggtggatt

SEQ ID NO: 8590 - DNA, 20 bp, Artificial Sequence
  Synthetic polynucleotide
cccttgttctgtctactctt

SEQ ID NO: 8591 - DNA, 20 bp, Artificial Sequence
  Synthetic polynucleotide
attcgtaataacccatccgg

SEQ ID NO: 8592 - DNA, 20 bp, Artificial Sequence
  Synthetic polynucleotide
tcctatggacatgcctagaa

SEQ ID NO: 8593 - DNA, 20 bp, Artificial Sequence
  Synthetic polynucleotide
atcatcatccagctgtttgt

SEQ ID NO: 8594 - DNA, 20 bp, Artificial Sequence
  Synthetic polynucleotide
accatctgttgctccttaag

SEQ ID NO: 8595 - DNA, 20 bp, Artificial Sequence
  Synthetic polynucleotide
gcaggacaagttattaaggc

SEQ ID NO: 8596 - DNA, 20 bp, Artificial Sequence
  Synthetic polynucleotide
ggaatcgaaatcagtcctgt

SEQ ID NO: 8597 - DNA, 20 bp, Artificial Sequence
  Synthetic polynucleotide
cgtcaaagcatcggatttag

SEQ ID NO: 8598 - DNA, 20 bp, Artificial Sequence
  Synthetic polynucleotide
caagtcaaccctaacaggaa

SEQ ID NO: 8599 - DNA, 20 bp, Artificial Sequence
  Synthetic polynucleotide
acgtcagcgaatttcaattc

SEQ ID NO: 8600 - DNA, 20 bp, Artificial Sequence
  Synthetic polynucleotide
tgcttcccggaattattgaa

SEQ ID NO: 8601 - DNA, 20 bp, Artificial Sequence
  Synthetic polynucleotide
ctttggcagtcaagaaagtc

SEQ ID NO: 8602 - DNA, 20 bp, Artificial Sequence
  Synthetic polynucleotide
gatttggaaccgaggatacc

SEQ ID NO: 8603 - DNA, 20 bp, Artificial Sequence
  Synthetic polynucleotide
tacgcaatgaccgattactt

SEQ ID NO: 8604 - DNA, 20 bp, Artificial Sequence
  Synthetic polynucleotide
caaagaaagcgccgatatac

SEQ ID NO: 8605 - DNA, 20 bp, Artificial Sequence
  Synthetic polynucleotide
gctggaaagtttgataaccg

SEQ ID NO: 8606 - DNA, 20 bp, Artificial Sequence
  Synthetic polynucleotide
catgatttcgtcgcaatagg

SEQ ID NO: 8607 - DNA, 20 bp, Artificial Sequence
  Synthetic polynucleotide
agagggctatgggaagtatt

SEQ ID NO: 8608 - DNA, 20 bp, Artificial Sequence
  Synthetic polynucleotide
tttgtacagccaatacggaa

SEQ ID NO: 8609 - DNA, 20 bp, Artificial Sequence
  Synthetic polynucleotide
cgtttatcggcactttcaaa

SEQ ID NO: 8610 - DNA, 18 bp, Artificial Sequence
  Synthetic polynucleotide
ttaatatggcctcggggg

SEQ ID NO: 8611 - DNA, 20 bp, Artificial Sequence
  Synthetic polynucleotide
catccgctaaatacacaacg

SEQ ID NO: 8612 - DNA, 20 bp, Artificial Sequence
  Synthetic polynucleotide
aaacacaaatggctgacatg

SEQ ID NO: 8613 - DNA, 20 bp, Artificial Sequence
  Synthetic polynucleotide
cgaatcctcggatatgatgg

SEQ ID NO: 8614 - DNA, 20 bp, Artificial Sequence
  Synthetic polynucleotide
ataatcttctctgcgttggg

SEQ ID NO: 8615 - DNA, 20 bp, Artificial Sequence
  Synthetic polynucleotide
gctcgattgagatctcacat

SEQ ID NO: 8616 - DNA, 20 bp, Artificial Sequence
  Synthetic polynucleotide
tcttcctccgagactacaat

SEQ ID NO: 8617 - DNA, 20 bp, Artificial Sequence
  Synthetic polynucleotide
tgtaccgaaaaatcccgaat

SEQ ID NO: 8618 - DNA, 20 bp, Artificial Sequence
  Synthetic polynucleotide
gggcattatcttgggattca

SEQ ID NO: 8619 - DNA, 20 bp, Artificial Sequence
  Synthetic polynucleotide
gaagcaactgacagaagaga

SEQ ID NO: 8620 - DNA, 20 bp, Artificial Sequence
  Synthetic polynucleotide
cctattggtcgccataatca

SEQ ID NO: 8621 - DNA, 20 bp, Artificial Sequence
  Synthetic polynucleotide
tatgccatggaagccatatc

SEQ ID NO: 8622 - DNA, 20 bp, Artificial Sequence
  Synthetic polynucleotide
agttcttccacttctttgct

SEQ ID NO: 8623 - DNA, 20 bp, Artificial Sequence
  Synthetic polynucleotide
gtgtaccttatgtcgctgat

SEQ ID NO: 8624 - DNA, 20 bp, Artificial Sequence
  Synthetic polynucleotide
cactcatttctgactccaca

SEQ ID NO: 8625 - DNA, 20 bp, Artificial Sequence
  Synthetic polynucleotide
caaccatcagtaccagaaca

SEQ ID NO: 8626 - DNA, 20 bp, Artificial Sequence
  Synthetic polynucleotide
aagtcttacttgacctgcag

SEQ ID NO: 8627 - DNA, 20 bp, Artificial Sequence
  Synthetic polynucleotide
ttaggactcagtttgctcac

SEQ ID NO: 8628 - DNA, 20 bp, Artificial Sequence
  Synthetic polynucleotide
tcttcggcttctgattgaaa

SEQ ID NO: 8629 - DNA, 18 bp, Artificial Sequence
  Synthetic polynucleotide
atacaagcccaaaccgtc

SEQ ID NO: 8630 - DNA, 19 bp, Artificial Sequence
  Synthetic polynucleotide
gatataaaccgtagcgccc

SEQ ID NO: 8631 - DNA, 20 bp, Artificial Sequence
  Synthetic polynucleotide
aatacacctccgtccttcta

SEQ ID NO: 8632 - DNA, 20 bp, Artificial Sequence
  Synthetic polynucleotide
ttcgtctactaagatgctgc

SEQ ID NO: 8633 - DNA, 20 bp, Artificial Sequence
  Synthetic polynucleotide
acatccaagaagccctaaag

SEQ ID NO: 8634 - DNA, 20 bp, Artificial Sequence
  Synthetic polynucleotide
agagtgtcatcaacttccac

SEQ ID NO: 8635 - DNA, 20 bp, Artificial Sequence
  Synthetic polynucleotide
tcgagccaactttagatgaa

SEQ ID NO: 8636 - DNA, 20 bp, Artificial Sequence
  Synthetic polynucleotide
tagtgtctcttgcttggatg

SEQ ID NO: 8637 - DNA, 20 bp, Artificial Sequence
  Synthetic polynucleotide
aatatgtcgcaatggacact

SEQ ID NO: 8638 - DNA, 20 bp, Artificial Sequence
  Synthetic polynucleotide
taaagatggcccgaaaactt

SEQ ID NO: 8639 - DNA, 20 bp, Artificial Sequence
  Synthetic polynucleotide
catcttcgcatatggtttcg

SEQ ID NO: 8640 - DNA, 20 bp, Artificial Sequence
  Synthetic polynucleotide
aagttgttctctcgcatctt

SEQ ID NO: 8641 - DNA, 20 bp, Artificial Sequence
  Synthetic polynucleotide
tactgtggaagataccgagt

SEQ ID NO: 8642 - DNA, 20 bp, Artificial Sequence
  Synthetic polynucleotide
ttattagccatagcagccag

SEQ ID NO: 8643 - DNA, 20 bp, Artificial Sequence
  Synthetic polynucleotide
gcaagatctagacatggagg

SEQ ID NO: 8644 - DNA, 20 bp, Artificial Sequence
  Synthetic polynucleotide
gtctgagcatcgaatctctt

SEQ ID NO: 8645 - DNA, 20 bp, Artificial Sequence
  Synthetic polynucleotide
gacgataaaaaccatgctgg

SEQ ID NO: 8646 - DNA, 20 bp, Artificial Sequence
  Synthetic polynucleotide
gcgtgaaatcgtttttgatg

SEQ ID NO: 8647 - DNA, 20 bp, Artificial Sequence
  Synthetic polynucleotide
tgtgtgataaggcgaaagaa

SEQ ID NO: 8648 - DNA, 20 bp, Artificial Sequence
  Synthetic polynucleotide
agtagtttggagcactgaag

SEQ ID NO: 8649 - DNA, 20 bp, Artificial Sequence
  Synthetic polynucleotide
ttaaagccaagatccaggac

SEQ ID NO: 8650 - DNA, 20 bp, Artificial Sequence
  Synthetic polynucleotide
acggccatcttctaattgtt

SEQ ID NO: 8651 - DNA, 20 bp, Artificial Sequence
  Synthetic polynucleotide
agaggcatggacaaattgat

SEQ ID NO: 8652 - DNA, 20 bp, Artificial Sequence
  Synthetic polynucleotide
gttgtacaggatgttccact

SEQ ID NO: 8653 - DNA, 20 bp, Artificial Sequence
  Synthetic polynucleotide
accctttcagagacgatcta

SEQ ID NO: 8654 - DNA, 20 bp, Artificial Sequence
  Synthetic polynucleotide
cagatcactcggaaggttag

SEQ ID NO: 8655 - DNA, 20 bp, Artificial Sequence
  Synthetic polynucleotide
cgagctattgggcttagaat

SEQ ID NO: 8656 - DNA, 20 bp, Artificial Sequence
  Synthetic polynucleotide
ttccatgcggagaaaataca

SEQ ID NO: 8657 - DNA, 20 bp, Artificial Sequence
  Synthetic polynucleotide
tagttcgcctgatttggaaa

SEQ ID NO: 8658 - DNA, 20 bp, Artificial Sequence
  Synthetic polynucleotide
cttcagtcccatgtacaaca

SEQ ID NO: 8659 - DNA, 20 bp, Artificial Sequence
  Synthetic polynucleotide
actgctcaattcgtagctag

SEQ ID NO: 8660 - DNA, 20 bp, Artificial Sequence
  Synthetic polynucleotide
tcttcaccagcactttatcc

SEQ ID NO: 8661 - DNA, 20 bp, Artificial Sequence
  Synthetic polynucleotide
agtggaccatttcaatcgaa

SEQ ID NO: 8662 - DNA, 20 bp, Artificial Sequence
  Synthetic polynucleotide
aaacgaattgttgaacgcat

SEQ ID NO: 8663 - DNA, 20 bp, Artificial Sequence
  Synthetic polynucleotide
agatcgaaacgacaaaaacg

SEQ ID NO: 8664 - DNA, 20 bp, Artificial Sequence
  Synthetic polynucleotide
ggatttttgcattcgtcgat

SEQ ID NO: 8665 - DNA, 20 bp, Artificial Sequence
  Synthetic polynucleotide
cgttgaacgccagattaatc

SEQ ID NO: 8666 - DNA, 20 bp, Artificial Sequence
  Synthetic polynucleotide
cagccgaaatgaaaacatct

SEQ ID NO: 8667 - DNA, 20 bp, Artificial Sequence
  Synthetic polynucleotide
tggaaaaataatcatgccgc

SEQ ID NO: 8668 - DNA, 20 bp, Artificial Sequence
  Synthetic polynucleotide
cgtacgcctgatgaaatcta

SEQ ID NO: 8669 - DNA, 20 bp, Artificial Sequence
  Synthetic polynucleotide
ttccaatttccgctgaaaac

SEQ ID NO: 8670 - DNA, 20 bp, Artificial Sequence
  Synthetic polynucleotide
gtaaactcctcttggcttca

SEQ ID NO: 8671 - DNA, 20 bp, Artificial Sequence
  Synthetic polynucleotide
aaaaagtggaatgctgtagc

SEQ ID NO: 8672 - DNA, 21 bp, Artificial Sequence
  Synthetic polynucleotide
cctgcctagtttttaaccatc

SEQ ID NO: 8673 - DNA, 20 bp, Artificial Sequence
  Synthetic polynucleotide
aacattgctagaacgacctt

SEQ ID NO: 8674 - DNA, 20 bp, Artificial Sequence
  Synthetic polynucleotide
tctgcctcgtctatgatttg

SEQ ID NO: 8675 - DNA, 20 bp, Artificial Sequence
  Synthetic polynucleotide
gcctccatcaagtcgaatat

SEQ ID NO: 8676 - DNA, 20 bp, Artificial Sequence
  Synthetic polynucleotide
ttagagccagataaggagca

SEQ ID NO: 8677 - DNA, 20 bp, Artificial Sequence
  Synthetic polynucleotide
gagcaaacgaatggaagaag

SEQ ID NO: 8678 - DNA, 20 bp, Artificial Sequence
  Synthetic polynucleotide
tttcctctagaaatacgccg

SEQ ID NO: 8679 - DNA, 20 bp, Artificial Sequence
  Synthetic polynucleotide
atctctgctatgggaactct

SEQ ID NO: 8680 - DNA, 20 bp, Artificial Sequence
  Synthetic polynucleotide
tataccagctgggaatgaac

SEQ ID NO: 8681 - DNA, 20 bp, Artificial Sequence
  Synthetic polynucleotide
cccacactaaaaggaggaaa

SEQ ID NO: 8682 - DNA, 20 bp, Artificial Sequence
  Synthetic polynucleotide
cagcaataagacccacctta

SEQ ID NO: 8683 - DNA, 20 bp, Artificial Sequence
  Synthetic polynucleotide
aacccatgcctatgaactac

SEQ ID NO: 8684 - DNA, 18 bp, Artificial Sequence
  Synthetic polynucleotide
gtgtcaagaagcctcacc

SEQ ID NO: 8685 - DNA, 20 bp, Artificial Sequence
  Synthetic polynucleotide
ttggagaagctgaaagtacc

SEQ ID NO: 8686 - DNA, 20 bp, Artificial Sequence
  Synthetic polynucleotide
gcccaatacatgctcgtata

SEQ ID NO: 8687 - DNA, 20 bp, Artificial Sequence
  Synthetic polynucleotide
ttcgatcaccccattcaatt

SEQ ID NO: 8688 - DNA, 20 bp, Artificial Sequence
  Synthetic polynucleotide
taacgtcgggattcatcttc

SEQ ID NO: 8689 - DNA, 20 bp, Artificial Sequence
  Synthetic polynucleotide
tgttcttgtgatgtgccata

SEQ ID NO: 8690 - DNA, 20 bp, Artificial Sequence
  Synthetic polynucleotide
ctcgatatccataccacgac

SEQ ID NO: 8691 - DNA, 20 bp, Artificial Sequence
  Synthetic polynucleotide
agaaacgatttcgaaggaca

SEQ ID NO: 8692 - DNA, 20 bp, Artificial Sequence
  Synthetic polynucleotide
ctttactcctcatgtagccc

SEQ ID NO: 8693 - DNA, 20 bp, Artificial Sequence
  Synthetic polynucleotide
gtattacggaacctctggac

SEQ ID NO: 8694 - DNA, 20 bp, Artificial Sequence
  Synthetic polynucleotide
gatgaacgtcgactccttta

SEQ ID NO: 8695 - DNA, 20 bp, Artificial Sequence
  Synthetic polynucleotide
aggaagttcgaattaggtcg

SEQ ID NO: 8696 - DNA, 19 bp, Artificial Sequence
  Synthetic polynucleotide
cttcgaggacgtaaccatc

SEQ ID NO: 8697 - DNA, 20 bp, Artificial Sequence
  Synthetic polynucleotide
catttcatccctagccctac

SEQ ID NO: 8698 - DNA, 20 bp, Artificial Sequence
  Synthetic polynucleotide
tttctcctcttcttccaacg

SEQ ID NO: 8699 - DNA, 20 bp, Artificial Sequence
  Synthetic polynucleotide
tgccagattcaacttacgaa

SEQ ID NO: 8700 - DNA, 20 bp, Artificial Sequence
  Synthetic polynucleotide
gttacgtgtacccttctctc

SEQ ID NO: 8701 - DNA, 20 bp, Artificial Sequence
  Synthetic polynucleotide
gttgaagtctgctttcgatt

SEQ ID NO: 8702 - DNA, 20 bp, Artificial Sequence
  Synthetic polynucleotide
taccaagtcgtccaactttt

SEQ ID NO: 8703 - DNA, 20 bp, Artificial Sequence
  Synthetic polynucleotide
tggaatatgccattgaagct

SEQ ID NO: 8704 - DNA, 20 bp, Artificial Sequence
  Synthetic polynucleotide
atatcctttggcgtcattgt

SEQ ID NO: 8705 - DNA, 20 bp, Artificial Sequence
  Synthetic polynucleotide
caattagttgggctatccga

SEQ ID NO: 8706 - DNA, 20 bp, Artificial Sequence
  Synthetic polynucleotide
accgtattgcttcttcttgt

SEQ ID NO: 8707 - DNA, 20 bp, Artificial Sequence
  Synthetic polynucleotide
agccgcagaactacttaaaa

SEQ ID NO: 8708 - DNA, 20 bp, Artificial Sequence
  Synthetic polynucleotide
cttcgccgaccatattagaa

SEQ ID NO: 8709 - DNA, 20 bp, Artificial Sequence
  Synthetic polynucleotide
gccttctataacttcccagg

SEQ ID NO: 8710 - DNA, 20 bp, Artificial Sequence
  Synthetic polynucleotide
ccttcgtccacatcgattat

SEQ ID NO: 8711 - DNA, 20 bp, Artificial Sequence
  Synthetic polynucleotide
tgttgatgaaggaactggag

SEQ ID NO: 8712 - DNA, 20 bp, Artificial Sequence
  Synthetic polynucleotide
gctgttaattgcaaccaagt

SEQ ID NO: 8713 - DNA, 20 bp, Artificial Sequence
  Synthetic polynucleotide
ggcctaaaaagaagatggga

SEQ ID NO: 8714 - DNA, 20 bp, Artificial Sequence
  Synthetic polynucleotide
cgggtaaatcttgactttgc

SEQ ID NO: 8715 - DNA, 20 bp, Artificial Sequence
  Synthetic polynucleotide
aaacgtagtcatgaactgct

SEQ ID NO: 8716 - DNA, 20 bp, Artificial Sequence
  Synthetic polynucleotide
cagaaccgctaaacattgtc

SEQ ID NO: 8717 - DNA, 20 bp, Artificial Sequence
  Synthetic polynucleotide
tggaatccaccttgttgaaa

SEQ ID NO: 8718 - DNA, 20 bp, Artificial Sequence
  Synthetic polynucleotide
caaacactatcaggacacca

SEQ ID NO: 8719 - DNA, 20 bp, Artificial Sequence
  Synthetic polynucleotide
caggagatcgaattgctgta

SEQ ID NO: 8720 - DNA, 20 bp, Artificial Sequence
  Synthetic polynucleotide
gttgtctccagtaacccatt

SEQ ID NO: 8721 - DNA, 20 bp, Artificial Sequence
  Synthetic polynucleotide
cgaacgtcaagaaggaattg

SEQ ID NO: 8722 - DNA, 20 bp, Artificial Sequence
  Synthetic polynucleotide
gattcaatgctctctctcgt

SEQ ID NO: 8723 - DNA, 20 bp, Artificial Sequence
  Synthetic polynucleotide
atttagtgccaagtctctgt

SEQ ID NO: 8724 - DNA, 19 bp, Artificial Sequence
  Synthetic polynucleotide
caccgacctcaagctattg

SEQ ID NO: 8725 - DNA, 20 bp, Artificial Sequence
  Synthetic polynucleotide
cgttgatatgccgatgaaag

SEQ ID NO: 8726 - DNA, 20 bp, Artificial Sequence
  Synthetic polynucleotide
atcgaccggttgatagaaag

SEQ ID NO: 8727 - DNA, 20 bp, Artificial Sequence
  Synthetic polynucleotide
tttaaggccccaattagacc

SEQ ID NO: 8728 - DNA, 20 bp, Artificial Sequence
  Synthetic polynucleotide
ctagacaaatcggtgttgga

SEQ ID NO: 8729 - DNA, 20 bp, Artificial Sequence
  Synthetic polynucleotide
gtaactgacgattcgactga

SEQ ID NO: 8730 - DNA, 20 bp, Artificial Sequence
  Synthetic polynucleotide
taatccagctttcgaacaca

SEQ ID NO: 8731 - DNA, 20 bp, Artificial Sequence
  Synthetic polynucleotide
aagaaatcttgggaagcgat

SEQ ID NO: 8732 - DNA, 20 bp, Artificial Sequence
  Synthetic polynucleotide
gcggtcgttttaatttccat

SEQ ID NO: 8733 - DNA, 20 bp, Artificial Sequence
  Synthetic polynucleotide
cccagacactttccaatgta

SEQ ID NO: 8734 - DNA, 20 bp, Artificial Sequence
  Synthetic polynucleotide
aagctatgatgcgcatctta

SEQ ID NO: 8735 - DNA, 20 bp, Artificial Sequence
  Synthetic polynucleotide
aaaattatggcggtgagact

SEQ ID NO: 8736 - DNA, 20 bp, Artificial Sequence
  Synthetic polynucleotide
caagtgctcgtaaacaactc

SEQ ID NO: 8737 - DNA, 20 bp, Artificial Sequence
  Synthetic polynucleotide
tagaaaccatcgatctgcag

SEQ ID NO: 8738 - DNA, 20 bp, Artificial Sequence
  Synthetic polynucleotide
gggattaaacataggaggcc

SEQ ID NO: 8739 - DNA, 20 bp, Artificial Sequence
  Synthetic polynucleotide
taacctgcgaaacgataacc

SEQ ID NO: 8740 - DNA, 20 bp, Artificial Sequence
  Synthetic polynucleotide
gctcgtagaattgcagactt

SEQ ID NO: 8741 - DNA, 20 bp, Artificial Sequence
  Synthetic polynucleotide
tattcgcaacattcagcaac

SEQ ID NO: 8742 - DNA, 20 bp, Artificial Sequence
  Synthetic polynucleotide
cttaagcactttaacagcgg

SEQ ID NO: 8743 - DNA, 20 bp, Artificial Sequence
  Synthetic polynucleotide
tgatcggatgactaacgaac

SEQ ID NO: 8744 - DNA, 20 bp, Artificial Sequence
  Synthetic polynucleotide
caatgatgtaattgtggccc

SEQ ID NO: 8745 - DNA, 20 bp, Artificial Sequence
  Synthetic polynucleotide
cgttggtaatcctcgaagat

SEQ ID NO: 8746 - DNA, 20 bp, Artificial Sequence
  Synthetic polynucleotide
cgcattgataggccaaaaat

SEQ ID NO: 8747 - DNA, 20 bp, Artificial Sequence
  Synthetic polynucleotide
atcagacgcagctactaaag

SEQ ID NO: 8748 - DNA, 20 bp, Artificial Sequence
  Synthetic polynucleotide
tatcgttgaacagcaattgc

SEQ ID NO: 8749 - DNA, 20 bp, Artificial Sequence
  Synthetic polynucleotide
aatcgacaagcacaagaaac

SEQ ID NO: 8750 - DNA, 20 bp, Artificial Sequence
  Synthetic polynucleotide
ctcgatatcttgttgcgatg

SEQ ID NO: 8751 - DNA, 20 bp, Artificial Sequence
  Synthetic polynucleotide
cgtgatgaaatacggcaaaa

SEQ ID NO: 8752 - DNA, 20 bp, Artificial Sequence
  Synthetic polynucleotide
ttttagagaaatcaggggcc

SEQ ID NO: 8753 - DNA, 20 bp, Artificial Sequence
  Synthetic polynucleotide
gctcatcctgataagctgaa

SEQ ID NO: 8754 - DNA, 20 bp, Artificial Sequence
  Synthetic polynucleotide
tttcttactggtttcctgca

SEQ ID NO: 8755 - DNA, 20 bp, Artificial Sequence
  Synthetic polynucleotide
taaatcggatctggccaaaa

SEQ ID NO: 8756 - DNA, 20 bp, Artificial Sequence
  Synthetic polynucleotide
ccatcactagatccacatgg

SEQ ID NO: 8757 - DNA, 20 bp, Artificial Sequence
  Synthetic polynucleotide
agatggtaagctgaaacctg

SEQ ID NO: 8758 - DNA, 20 bp, Artificial Sequence
  Synthetic polynucleotide
tcttggcttttccaggattt

SEQ ID NO: 8759 - DNA, 20 bp, Artificial Sequence
  Synthetic polynucleotide
cttcgcaaagaattctcacc

SEQ ID NO: 8760 - DNA, 20 bp, Artificial Sequence
  Synthetic polynucleotide
ttgaatatggactgcttgct

SEQ ID NO: 8761 - DNA, 20 bp, Artificial Sequence
  Synthetic polynucleotide
ttcttggaaggttttggtga

SEQ ID NO: 8762 - DNA, 20 bp, Artificial Sequence
  Synthetic polynucleotide
atggtaggtgcagtaggtat

SEQ ID NO: 8763 - DNA, 20 bp, Artificial Sequence
  Synthetic polynucleotide
catctttggctccgaaaatc

SEQ ID NO: 8764 - DNA, 20 bp, Artificial Sequence
  Synthetic polynucleotide
tttgccgtcaattgtacaac

SEQ ID NO: 8765 - DNA, 20 bp, Artificial Sequence
  Synthetic polynucleotide
ctgaggcctctaactttgag

SEQ ID NO: 8766 - DNA, 20 bp, Artificial Sequence
  Synthetic polynucleotide
tacaagcacattccagtcaa

SEQ ID NO: 8767 - DNA, 20 bp, Artificial Sequence
  Synthetic polynucleotide
ctgaaagaaggagtaaccgg

SEQ ID NO: 8768 - DNA, 20 bp, Artificial Sequence
  Synthetic polynucleotide
atccatttttgtcctggtga

SEQ ID NO: 8769 - DNA, 20 bp, Artificial Sequence
  Synthetic polynucleotide
cacaccgataatatggagca

SEQ ID NO: 8770 - DNA, 20 bp, Artificial Sequence
  Synthetic polynucleotide
gtttcctttggctacgattg

SEQ ID NO: 8771 - DNA, 19 bp, Artificial Sequence
  Synthetic polynucleotide
ctccgctgatgtcgaaaaa

SEQ ID NO: 8772 - DNA, 20 bp, Artificial Sequence
  Synthetic polynucleotide
gattctttcttttcctcggc

SEQ ID NO: 8773 - DNA, 20 bp, Artificial Sequence
  Synthetic polynucleotide
accgaacattccaataagct

SEQ ID NO: 8774 - DNA, 20 bp, Artificial Sequence
  Synthetic polynucleotide
catcttacccatagcttccc

SEQ ID NO: 8775 - DNA, 20 bp, Artificial Sequence
  Synthetic polynucleotide
agcggtttctacaacatctt

SEQ ID NO: 8776 - DNA, 20 bp, Artificial Sequence
  Synthetic polynucleotide
ggagtcctgcattttactga

SEQ ID NO: 8777 - DNA, 20 bp, Artificial Sequence
  Synthetic polynucleotide
ccgggaaattgctgttttta

SEQ ID NO: 8778 - DNA, 20 bp, Artificial Sequence
  Synthetic polynucleotide
gaatcgagcacataaacagc

SEQ ID NO: 8779 - DNA, 20 bp, Artificial Sequence
  Synthetic polynucleotide
tacgctcaaatctccaacaa

SEQ ID NO: 8780 - DNA, 20 bp, Artificial Sequence
  Synthetic polynucleotide
gctgcgaaaacaacaactta

SEQ ID NO: 8781 - DNA, 20 bp, Artificial Sequence
  Synthetic polynucleotide
agaccctgacttacgataca

SEQ ID NO: 8782 - DNA, 20 bp, Artificial Sequence
  Synthetic polynucleotide
gtacctcgtcatcgaattca

SEQ ID NO: 8783 - DNA, 20 bp, Artificial Sequence
  Synthetic polynucleotide
tatatacgcaatcggagcag

SEQ ID NO: 8784 - DNA, 20 bp, Artificial Sequence
  Synthetic polynucleotide
cctttactagccttgctctt

SEQ ID NO: 8785 - DNA, 20 bp, Artificial Sequence
  Synthetic polynucleotide
atcaagaaggacgatatggc

SEQ ID NO: 8786 - DNA, 20 bp, Artificial Sequence
  Synthetic polynucleotide
tcagccaaattcgagaagaa

SEQ ID NO: 8787 - DNA, 20 bp, Artificial Sequence
  Synthetic polynucleotide
attgttcgattacggcaaac

SEQ ID NO: 8788 - DNA, 20 bp, Artificial Sequence
  Synthetic polynucleotide
tcattttcaactctggcgta

SEQ ID NO: 8789 - DNA, 20 bp, Artificial Sequence
  Synthetic polynucleotide
agtccaacaggcgaattaat

SEQ ID NO: 8790 - DNA, 20 bp, Artificial Sequence
  Synthetic polynucleotide
gacattctggtgtttgcaaa

SEQ ID NO: 8791 - DNA, 20 bp, Artificial Sequence
  Synthetic polynucleotide
gacgcaggctattagaaaga

SEQ ID NO: 8792 - DNA, 20 bp, Artificial Sequence
  Synthetic polynucleotide
attccttctcgtcatatggc

SEQ ID NO: 8793 - DNA, 20 bp, Artificial Sequence
  Synthetic polynucleotide
cgaagaaagaaggaggttga

SEQ ID NO: 8794 - DNA, 20 bp, Artificial Sequence
  Synthetic polynucleotide
aagaggagcttcactgaaag

SEQ ID NO: 8795 - DNA, 20 bp, Artificial Sequence
  Synthetic polynucleotide
cggtaaaacgtgtcttttga

SEQ ID NO: 8796 - DNA, 20 bp, Artificial Sequence
  Synthetic polynucleotide
gagtggcattctcgaatact

SEQ ID NO: 8797 - DNA, 20 bp, Artificial Sequence
  Synthetic polynucleotide
taccaacacaattttcccca

SEQ ID NO: 8798 - DNA, 20 bp, Artificial Sequence
  Synthetic polynucleotide
tgcatcttccgtcttgtaaa

SEQ ID NO: 8799 - DNA, 20 bp, Artificial Sequence
  Synthetic polynucleotide
tcgttcgaaacagaacttct

SEQ ID NO: 8800 - DNA, 20 bp, Artificial Sequence
  Synthetic polynucleotide
gacaacagccactcttctaa

SEQ ID NO: 8801 - DNA, 20 bp, Artificial Sequence
  Synthetic polynucleotide
ccagaactatcccctattgc

SEQ ID NO: 8802 - DNA, 20 bp, Artificial Sequence
  Synthetic polynucleotide
agacttcagctgctctagta

SEQ ID NO: 8803 - DNA, 20 bp, Artificial Sequence
  Synthetic polynucleotide
atcacgttcgaatgcataga

SEQ ID NO: 8804 - DNA, 20 bp, Artificial Sequence
  Synthetic polynucleotide
gaagtttcggttgtttggtt

SEQ ID NO: 8805 - DNA, 20 bp, Artificial Sequence
  Synthetic polynucleotide
tttaccaaacgccattcaac

SEQ ID NO: 8806 - DNA, 20 bp, Artificial Sequence
  Synthetic polynucleotide
aacaattcgggctcataact

SEQ ID NO: 8807 - DNA, 20 bp, Artificial Sequence
  Synthetic polynucleotide
gctgatcaaatgagcttcac

SEQ ID NO: 8808 - DNA, 20 bp, Artificial Sequence
  Synthetic polynucleotide
gccgatgacaattgactttg

SEQ ID NO: 8809 - DNA, 20 bp, Artificial Sequence
  Synthetic polynucleotide
agaattgaaggagaagcagg

SEQ ID NO: 8810 - DNA, 20 bp, Artificial Sequence
  Synthetic polynucleotide
acacgtcctgtttctttctt

SEQ ID NO: 8811 - DNA, 20 bp, Artificial Sequence
  Synthetic polynucleotide
gcgatagagaaaggtggatt

SEQ ID NO: 8812 - DNA, 20 bp, Artificial Sequence
  Synthetic polynucleotide
ccttgttttgtctgctcttc

SEQ ID NO: 8813 - DNA, 20 bp, Artificial Sequence
  Synthetic polynucleotide
aacaagcttggcaaacttac

SEQ ID NO: 8814 - DNA, 20 bp, Artificial Sequence
  Synthetic polynucleotide
tcctatggacatgcctagaa

SEQ ID NO: 8815 - DNA, 20 bp, Artificial Sequence
  Synthetic polynucleotide
attgggtatttctccgatcg

SEQ ID NO: 8816 - DNA, 20 bp, Artificial Sequence
  Synthetic polynucleotide
cgccaacatctgggatataa

SEQ ID NO: 8817 - DNA, 20 bp, Artificial Sequence
  Synthetic polynucleotide
aatttaaccaccatcggtca

SEQ ID NO: 8818 - DNA, 20 bp, Artificial Sequence
  Synthetic polynucleotide
aaaacgtcgacacatcctta

SEQ ID NO: 8819 - DNA, 20 bp, Artificial Sequence
  Synthetic polynucleotide
ctcctgctgaatattcgtca

SEQ ID NO: 8820 - DNA, 20 bp, Artificial Sequence
  Synthetic polynucleotide
atatgagcttttggcaggaa

SEQ ID NO: 8821 - DNA, 20 bp, Artificial Sequence
  Synthetic polynucleotide
caaccccttattcgaaaagc

SEQ ID NO: 8822 - DNA, 20 bp, Artificial Sequence
  Synthetic polynucleotide
gactcccattttcctacaca

SEQ ID NO: 8823 - DNA, 20 bp, Artificial Sequence
  Synthetic polynucleotide
gatcctcacatactccacac

SEQ ID NO: 8824 - DNA, 20 bp, Artificial Sequence
  Synthetic polynucleotide
ggattaactttctggaccgt

SEQ ID NO: 8825 - DNA, 20 bp, Artificial Sequence
  Synthetic polynucleotide
gccggtttacaactgaaaaa

SEQ ID NO: 8826 - DNA, 20 bp, Artificial Sequence
  Synthetic polynucleotide
tgcttcagtatcttcgatgg

SEQ ID NO: 8827 - DNA, 20 bp, Artificial Sequence
  Synthetic polynucleotide
ccaccgaaagactaatcgat

SEQ ID NO: 8828 - DNA, 20 bp, Artificial Sequence
  Synthetic polynucleotide
taaagttcctccgcatttca

SEQ ID NO: 8829 - DNA, 20 bp, Artificial Sequence
  Synthetic polynucleotide
tatcggcacctttaaagctt

SEQ ID NO: 8830 - DNA, 18 bp, Artificial Sequence
  Synthetic polynucleotide
ggacccctcatacccatc

SEQ ID NO: 8831 - DNA, 20 bp, Artificial Sequence
  Synthetic polynucleotide
acttgtttggccatatggaa

SEQ ID NO: 8832 - DNA, 20 bp, Artificial Sequence
  Synthetic polynucleotide
caaaaaggtagccatctcct

SEQ ID NO: 8833 - DNA, 20 bp, Artificial Sequence
  Synthetic polynucleotide
attgttcgattacggcaaac

SEQ ID NO: 8834 - DNA, 20 bp, Artificial Sequence
  Synthetic polynucleotide
tcattttcaactctggcgta

SEQ ID NO: 8835 - DNA, 20 bp, Artificial Sequence
  Synthetic polynucleotide
ttgatgaagaaagaggcgaa

SEQ ID NO: 8836 - DNA, 20 bp, Artificial Sequence
  Synthetic polynucleotide
ccgttttgcctttaaacact

SEQ ID NO: 8837 - DNA, 20 bp, Artificial Sequence
  Synthetic polynucleotide
cgaagagaaactgaaggaca

SEQ ID NO: 8838 - DNA, 20 bp, Artificial Sequence
  Synthetic polynucleotide
acgtttcccattgatctcaa

SEQ ID NO: 8839 - DNA, 20 bp, Artificial Sequence
  Synthetic polynucleotide
agtggaatccaggctaaaag

SEQ ID NO: 8840 - DNA, 20 bp, Artificial Sequence
  Synthetic polynucleotide
tgtcctaacgaatcgaatcc

SEQ ID NO: 8841 - DNA, 20 bp, Artificial Sequence
  Synthetic polynucleotide
attgtaccaagtcgagtacg

SEQ ID NO: 8842 - DNA, 20 bp, Artificial Sequence
  Synthetic polynucleotide
agttcttccacttctttgct

SEQ ID NO: 8843 - DNA, 20 bp, Artificial Sequence
  Synthetic polynucleotide
tacttcacatttgctccgaa

SEQ ID NO: 8844 - DNA, 20 bp, Artificial Sequence
  Synthetic polynucleotide
ttaccagcttgaccaactac

SEQ ID NO: 8845 - DNA, 20 bp, Artificial Sequence
  Synthetic polynucleotide
ttcctaatccgagctttacg

SEQ ID NO: 8846 - DNA, 20 bp, Artificial Sequence
  Synthetic polynucleotide
gaagccccattcttacttga

SEQ ID NO: 8847 - DNA, 20 bp, Artificial Sequence
  Synthetic polynucleotide
gccttctagtccaaatccaa

SEQ ID NO: 8848 - DNA, 20 bp, Artificial Sequence
  Synthetic polynucleotide
attatgatcagaagcccgtc

SEQ ID NO: 8849 - DNA, 20 bp, Artificial Sequence
  Synthetic polynucleotide
tagcaatgaaaggcgaaaac

SEQ ID NO: 8850 - DNA, 20 bp, Artificial Sequence
  Synthetic polynucleotide
atataaaccgtagctcccca

SEQ ID NO: 8851 - DNA, 20 bp, Artificial Sequence
  Synthetic polynucleotide
ggatatcagtcggagcaatt

SEQ ID NO: 8852 - DNA, 20 bp, Artificial Sequence
  Synthetic polynucleotide
cgtaacacctgaggtttgta

SEQ ID NO: 8853 - DNA, 20 bp, Artificial Sequence
  Synthetic polynucleotide
aagactctaaaaacgacccc

SEQ ID NO: 8854 - DNA, 20 bp, Artificial Sequence
  Synthetic polynucleotide
ttgagacacgatccatttgt

SEQ ID NO: 8855 - DNA, 22 bp, Artificial Sequence
  Synthetic polynucleotide
caacattggacgaattagaaca

SEQ ID NO: 8856 - DNA, 20 bp, Artificial Sequence
  Synthetic polynucleotide
gttccgaaattggtgtctct

SEQ ID NO: 8857 - DNA, 20 bp, Artificial Sequence
  Synthetic polynucleotide
ggctcacaatttggaagatg

SEQ ID NO: 8858 - DNA, 20 bp, Artificial Sequence
  Synthetic polynucleotide
aacagtgaaagatgttccga

SEQ ID NO: 8859 - DNA, 20 bp, Artificial Sequence
  Synthetic polynucleotide
ctgtgtttatcccctacgag

SEQ ID NO: 8860 - DNA, 20 bp, Artificial Sequence
  Synthetic polynucleotide
aacgtcggtagtgatcaaaa

SEQ ID NO: 8861 - DNA, 20 bp, Artificial Sequence
  Synthetic polynucleotide
caacagtcgagtctcttagg

SEQ ID NO: 8862 - DNA, 20 bp, Artificial Sequence
  Synthetic polynucleotide
ttattagccatagcagccag

SEQ ID NO: 8863 - DNA, 20 bp, Artificial Sequence
  Synthetic polynucleotide
agggaattactgaaaccgtc

SEQ ID NO: 8864 - DNA, 20 bp, Artificial Sequence
  Synthetic polynucleotide
cctccaaatcaacctcttca

SEQ ID NO: 8865 - DNA, 20 bp, Artificial Sequence
  Synthetic polynucleotide
cggtgaccataaaaaccatg

SEQ ID NO: 8866 - DNA, 20 bp, Artificial Sequence
  Synthetic polynucleotide
cgtgaaatcgttcttgatgt

SEQ ID NO: 8867 - DNA, 20 bp, Artificial Sequence
  Synthetic polynucleotide
tgtgtgataaggcgaaagaa

SEQ ID NO: 8868 - DNA, 20 bp, Artificial Sequence
  Synthetic polynucleotide
agtagtttggagcactgaag

SEQ ID NO: 8869 - DNA, 20 bp, Artificial Sequence
  Synthetic polynucleotide
agctaaaatccaggacaagg

SEQ ID NO: 8870 - DNA, 20 bp, Artificial Sequence
  Synthetic polynucleotide
aagatcaatctctgctggtc

SEQ ID NO: 8871 - DNA, 20 bp, Artificial Sequence
  Synthetic polynucleotide
gaagcaactgaagtcctaca

SEQ ID NO: 8872 - DNA, 20 bp, Artificial Sequence
  Synthetic polynucleotide
tccaatttgcttctcttcga

SEQ ID NO: 8873 - DNA, 20 bp, Artificial Sequence
  Synthetic polynucleotide
gtcgctgaagatatcccatt

SEQ ID NO: 8874 - DNA, 20 bp, Artificial Sequence
  Synthetic polynucleotide
catttcggtggatagtacgt

SEQ ID NO: 8875 - DNA, 20 bp, Artificial Sequence
  Synthetic polynucleotide
caagttttcggagttcttcg

SEQ ID NO: 8876 - DNA, 20 bp, Artificial Sequence
  Synthetic polynucleotide
cgaaatgcaccaaatcgtta

SEQ ID NO: 8877 - DNA, 20 bp, Artificial Sequence
  Synthetic polynucleotide
gcgagctattggtcttagaa

SEQ ID NO: 8878 - DNA, 20 bp, Artificial Sequence
  Synthetic polynucleotide
gaaaacacatcatcggttcc

SEQ ID NO: 8879 - DNA, 20 bp, Artificial Sequence
  Synthetic polynucleotide
agggcgagagatgaaaaatt

SEQ ID NO: 8880 - DNA, 20 bp, Artificial Sequence
  Synthetic polynucleotide
gcttttacaatttcgccgta

SEQ ID NO: 8881 - DNA, 20 bp, Artificial Sequence
  Synthetic polynucleotide
cttggaggagcagatacatc

SEQ ID NO: 8882 - DNA, 20 bp, Artificial Sequence
  Synthetic polynucleotide
gaacatcccgtcgaagaata

SEQ ID NO: 8883 - DNA, 20 bp, Artificial Sequence
  Synthetic polynucleotide
aaaggagtcttggatgtgtc

SEQ ID NO: 8884 - DNA, 20 bp, Artificial Sequence
  Synthetic polynucleotide
ccttgtccttcttctcttcc

SEQ ID NO: 8885 - DNA, 20 bp, Artificial Sequence
  Synthetic polynucleotide
aatatcgctttagatgcggt

SEQ ID NO: 8886 - DNA, 20 bp, Artificial Sequence
  Synthetic polynucleotide
ggttcctttcgatttcgttc

SEQ ID NO: 8887 - DNA, 20 bp, Artificial Sequence
  Synthetic polynucleotide
cagattaatccgtacgctga

SEQ ID NO: 8888 - DNA, 20 bp, Artificial Sequence
  Synthetic polynucleotide
taaatatccctttctgcggc

SEQ ID NO: 8889 - DNA, 20 bp, Artificial Sequence
  Synthetic polynucleotide
aaatgttactcagtggccat

SEQ ID NO: 8890 - DNA, 20 bp, Artificial Sequence
  Synthetic polynucleotide
gacgaagaatctttgcgttt

SEQ ID NO: 8891 - DNA, 20 bp, Artificial Sequence
  Synthetic polynucleotide
accactttaggctcgaaaat

SEQ ID NO: 8892 - DNA, 20 bp, Artificial Sequence
  Synthetic polynucleotide
aaagcatcgtgtaaactcct

SEQ ID NO: 8893 - DNA, 20 bp, Artificial Sequence
  Synthetic polynucleotide
aaaagtggaatgctgtagct

SEQ ID NO: 8894 - DNA, 22 bp, Artificial Sequence
  Synthetic polynucleotide
tgcctagtttttaaccatcttg

SEQ ID NO: 8895 - DNA, 20 bp, Artificial Sequence
  Synthetic polynucleotide
gccaacttagaaacgttcag

SEQ ID NO: 8896 - DNA, 20 bp, Artificial Sequence
  Synthetic polynucleotide
gattctgctttctttcaccg

SEQ ID NO: 8897 - DNA, 20 bp, Artificial Sequence
  Synthetic polynucleotide
ccagtcacgccgttataata

SEQ ID NO: 8898 - DNA, 20 bp, Artificial Sequence
  Synthetic polynucleotide
cgattccctcaaaggatcag

SEQ ID NO: 8899 - DNA, 20 bp, Artificial Sequence
  Synthetic polynucleotide
ttaccgggttcgtacaaatt

SEQ ID NO: 8900 - DNA, 20 bp, Artificial Sequence
  Synthetic polynucleotide
gaaatctctgacggtcgtaa

SEQ ID NO: 8901 - DNA, 20 bp, Artificial Sequence
  Synthetic polynucleotide
taagagtcaacaaggcttcc

SEQ ID NO: 8902 - DNA, 20 bp, Artificial Sequence
  Synthetic polynucleotide
tctccaattaggcggtaaag

SEQ ID NO: 8903 - DNA, 20 bp, Artificial Sequence
  Synthetic polynucleotide
cacactaagaggaggaaagg

SEQ ID NO: 8904 - DNA, 20 bp, Artificial Sequence
  Synthetic polynucleotide
cagcaataagaccgacctta

SEQ ID NO: 8905 - DNA, 19 bp, Artificial Sequence
  Synthetic polynucleotide
taaacaactggccaccaaa

SEQ ID NO: 8906 - DNA, 20 bp, Artificial Sequence
  Synthetic polynucleotide
gaacagacccaccaagtatg

SEQ ID NO: 8907 - DNA, 20 bp, Artificial Sequence
  Synthetic polynucleotide
caacaaggaatcgttaaccg

SEQ ID NO: 8908 - DNA, 20 bp, Artificial Sequence
  Synthetic polynucleotide
ggcgttattgatagccctta

SEQ ID NO: 8909 - DNA, 20 bp, Artificial Sequence
  Synthetic polynucleotide
tcaaaatcaaagtgttgggc

SEQ ID NO: 8910 - DNA, 20 bp, Artificial Sequence
  Synthetic polynucleotide
gatttgggttgttgaacgtt

SEQ ID NO: 8911 - DNA, 20 bp, Artificial Sequence
  Synthetic polynucleotide
cgtttcagcaagtacatgtc

SEQ ID NO: 8912 - DNA, 20 bp, Artificial Sequence
  Synthetic polynucleotide
ctcgatatccataccacgac

SEQ ID NO: 8913 - DNA, 20 bp, Artificial Sequence
  Synthetic polynucleotide
ccagaaggaaactaaacgga

SEQ ID NO: 8914 - DNA, 20 bp, Artificial Sequence
  Synthetic polynucleotide
gcctgggttaattggaagta

SEQ ID NO: 8915 - DNA, 20 bp, Artificial Sequence
  Synthetic polynucleotide
caagacggttatcgaggaat

SEQ ID NO: 8916 - DNA, 20 bp, Artificial Sequence
  Synthetic polynucleotide
atagcaacatcgataacccc

SEQ ID NO: 8917 - DNA, 20 bp, Artificial Sequence
  Synthetic polynucleotide
cgtaagaagaggaagttcga

SEQ ID NO: 8918 - DNA, 20 bp, Artificial Sequence
  Synthetic polynucleotide
ttgtccaggtctagatgcta

SEQ ID NO: 8919 - DNA, 20 bp, Artificial Sequence
  Synthetic polynucleotide
ctgtgagagtcatagacgtg

SEQ ID NO: 8920 - DNA, 20 bp, Artificial Sequence
  Synthetic polynucleotide
gcctcttgggatcttgttta

SEQ ID NO: 8921 - DNA, 20 bp, Artificial Sequence
  Synthetic polynucleotide
tttggtgtcccttatgatgg

SEQ ID NO: 8922 - DNA, 20 bp, Artificial Sequence
  Synthetic polynucleotide
tacataccagcctcagtaca

SEQ ID NO: 8923 - DNA, 20 bp, Artificial Sequence
  Synthetic polynucleotide
tgaagtccgctttcgattta

SEQ ID NO: 8924 - DNA, 20 bp, Artificial Sequence
  Synthetic polynucleotide
tttaccaagtcgtccagttt

SEQ ID NO: 8925 - DNA, 20 bp, Artificial Sequence
  Synthetic polynucleotide
aattgggatccacagctatc

SEQ ID NO: 8926 - DNA, 20 bp, Artificial Sequence
  Synthetic polynucleotide
caaatcctttggcgtcattg

SEQ ID NO: 8927 - DNA, 20 bp, Artificial Sequence
  Synthetic polynucleotide
atgatttgggaaagctggat

SEQ ID NO: 8928 - DNA, 20 bp, Artificial Sequence
  Synthetic polynucleotide
accgtattgcttcttcttgt

SEQ ID NO: 8929 - DNA, 20 bp, Artificial Sequence
  Synthetic polynucleotide
ctatacccgtggaggaattg

SEQ ID NO: 8930 - DNA, 20 bp, Artificial Sequence
  Synthetic polynucleotide
tcggacctttgataacgatc

SEQ ID NO: 8931 - DNA, 20 bp, Artificial Sequence
  Synthetic polynucleotide
ggggctttctataacttccc

SEQ ID NO: 8932 - DNA, 20 bp, Artificial Sequence
  Synthetic polynucleotide
ttcccaactgatatttcggg

SEQ ID NO: 8933 - DNA, 20 bp, Artificial Sequence
  Synthetic polynucleotide
aaattgaacccaccgaaaac

SEQ ID NO: 8934 - DNA, 20 bp, Artificial Sequence
  Synthetic polynucleotide
cagcttcagaaacaacgtac

SEQ ID NO: 8935 - DNA, 20 bp, Artificial Sequence
  Synthetic polynucleotide
tcgatacagcttgcgaaata

SEQ ID NO: 8936 - DNA, 20 bp, Artificial Sequence
  Synthetic polynucleotide
acacgttttgaacagacaac

SEQ ID NO: 8937 - DNA, 20 bp, Artificial Sequence
  Synthetic polynucleotide
aggaaccgaacctctatgta

SEQ ID NO: 8938 - DNA, 20 bp, Artificial Sequence
  Synthetic polynucleotide
atacttcgtctgtatggcac

SEQ ID NO: 8939 - DNA, 20 bp, Artificial Sequence
  Synthetic polynucleotide
ttcgataccggaatgtacac

SEQ ID NO: 8940 - DNA, 20 bp, Artificial Sequence
  Synthetic polynucleotide
caaacactatcaggacacca

SEQ ID NO: 8941 - DNA, 20 bp, Artificial Sequence
  Synthetic polynucleotide
agtagaggtcgagaatcaca

SEQ ID NO: 8942 - DNA, 20 bp, Artificial Sequence
  Synthetic polynucleotide
aatctcacaaactgaccctc

SEQ ID NO: 8943 - DNA, 20 bp, Artificial Sequence
  Synthetic polynucleotide
ctgagaatccacaccaagaa

SEQ ID NO: 8944 - DNA, 20 bp, Artificial Sequence
  Synthetic polynucleotide
gcaccgattatgaaaacgtt

SEQ ID NO: 8945 - DNA, 21 bp, Artificial Sequence
  Synthetic polynucleotide
atttagtgccaagtctttgtg

SEQ ID NO: 8946 - DNA, 20 bp, Artificial Sequence
  Synthetic polynucleotide
caccgatctcaagctattga

SEQ ID NO: 8947 - DNA, 20 bp, Artificial Sequence
  Synthetic polynucleotide
cgttgatatgccgatgaaag

SEQ ID NO: 8948 - DNA, 20 bp, Artificial Sequence
  Synthetic polynucleotide
tgacagtaccaaagtccatg

SEQ ID NO: 8949 - DNA, 20 bp, Artificial Sequence
  Synthetic polynucleotide
caatttcgttcatcagcagg

SEQ ID NO: 8950 - DNA, 20 bp, Artificial Sequence
  Synthetic polynucleotide
ggtattggacatcttgggtt

SEQ ID NO: 8951 - DNA, 20 bp, Artificial Sequence
  Synthetic polynucleotide
caagaatgtccactggaaga

SEQ ID NO: 8952 - DNA, 20 bp, Artificial Sequence
  Synthetic polynucleotide
tgctcatatgcttcatcctc

SEQ ID NO: 8953 - DNA, 20 bp, Artificial Sequence
  Synthetic polynucleotide
ttgtcgagactcctactgat

SEQ ID NO: 8954 - DNA, 20 bp, Artificial Sequence
  Synthetic polynucleotide
gtatgttctttgctcagcac

SEQ ID NO: 8955 - DNA, 20 bp, Artificial Sequence
  Synthetic polynucleotide
agaggagcacacgtattttt

SEQ ID NO: 8956 - DNA, 20 bp, Artificial Sequence
  Synthetic polynucleotide
gatgtaagtgagtggcgtat

SEQ ID NO: 8957 - DNA, 20 bp, Artificial Sequence
  Synthetic polynucleotide
tcgaagagccatcaaaagaa

SEQ ID NO: 8958 - DNA, 20 bp, Artificial Sequence
  Synthetic polynucleotide
atgtgctcgtaaacaactct

SEQ ID NO: 8959 - DNA, 20 bp, Artificial Sequence
  Synthetic polynucleotide
aaaatcacctggggtcttac

SEQ ID NO: 8960 - DNA, 20 bp, Artificial Sequence
  Synthetic polynucleotide
attaaacataggaggcctgg

SEQ ID NO: 8961 - DNA, 20 bp, Artificial Sequence
  Synthetic polynucleotide
aaactataaccggcgaagtt

SEQ ID NO: 8962 - DNA, 20 bp, Artificial Sequence
  Synthetic polynucleotide
gtgcttgagctcgtagaata

SEQ ID NO: 8963 - DNA, 20 bp, Artificial Sequence
  Synthetic polynucleotide
caagtcggagccaatttaac

SEQ ID NO: 8964 - DNA, 20 bp, Artificial Sequence
  Synthetic polynucleotide
ttatggctacggaactaacg

SEQ ID NO: 8965 - DNA, 20 bp, Artificial Sequence
  Synthetic polynucleotide
acgaaaatgatcggatgact

SEQ ID NO: 8966 - DNA, 20 bp, Artificial Sequence
  Synthetic polynucleotide
cacaatgatgtagttgtggc

SEQ ID NO: 8967 - DNA, 20 bp, Artificial Sequence
  Synthetic polynucleotide
cgttggttatcctcgaagat

SEQ ID NO: 8968 - DNA, 20 bp, Artificial Sequence
  Synthetic polynucleotide
tcaatatgaccaacacgtgt

SEQ ID NO: 8969 - DNA, 20 bp, Artificial Sequence
  Synthetic polynucleotide
cgtttcgggatcgtacatat

SEQ ID NO: 8970 - DNA, 21 bp, Artificial Sequence
  Synthetic polynucleotide
tcgaaaatgaacgaaatacgc

SEQ ID NO: 8971 - DNA, 20 bp, Artificial Sequence
  Synthetic polynucleotide
actacggcatacaagtgatc

SEQ ID NO: 8972 - DNA, 20 bp, Artificial Sequence
  Synthetic polynucleotide
cgccatgactactatgaaca

SEQ ID NO: 8973 - DNA, 20 bp, Artificial Sequence
  Synthetic polynucleotide
gaaatcgacaagcacaagaa

SEQ ID NO: 8974 - DNA, 20 bp, Artificial Sequence
  Synthetic polynucleotide
gttcgatgtcctgttgagag

SEQ ID NO: 8975 - DNA, 20 bp, Artificial Sequence
  Synthetic polynucleotide
ggcgaattcgagaaaaagta

SEQ ID NO: 8976 - DNA, 20 bp, Artificial Sequence
  Synthetic polynucleotide
atccttctccaactgttgtt

SEQ ID NO: 8977 - DNA, 20 bp, Artificial Sequence
  Synthetic polynucleotide
taccagggctacttcttagg

SEQ ID NO: 8978 - DNA, 20 bp, Artificial Sequence
  Synthetic polynucleotide
ctagatagactgcaccgttt

SEQ ID NO: 8979 - DNA, 20 bp, Artificial Sequence
  Synthetic polynucleotide
caaatgcgaaatggttacga

SEQ ID NO: 8980 - DNA, 20 bp, Artificial Sequence
  Synthetic polynucleotide
cgaagtgacctcgtcatatt

SEQ ID NO: 8981 - DNA, 20 bp, Artificial Sequence
  Synthetic polynucleotide
gctcatcctgataagctgaa

SEQ ID NO: 8982 - DNA, 20 bp, Artificial Sequence
  Synthetic polynucleotide
tcttcttactggtttcctgc

SEQ ID NO: 8983 - DNA, 20 bp, Artificial Sequence
  Synthetic polynucleotide
aaaattagagcaaagcgacg

SEQ ID NO: 8984 - DNA, 20 bp, Artificial Sequence
  Synthetic polynucleotide
tgggtatggcgaatagattg

SEQ ID NO: 8985 - DNA, 20 bp, Artificial Sequence
  Synthetic polynucleotide
cgtaaacaacataagtggcc

SEQ ID NO: 8986 - DNA, 20 bp, Artificial Sequence
  Synthetic polynucleotide
cccaggatttctatactcgc

SEQ ID NO: 8987 - DNA, 22 bp, Artificial Sequence
  Synthetic polynucleotide
agatgaacgaattagagaagct

SEQ ID NO: 8988 - DNA, 20 bp, Artificial Sequence
  Synthetic polynucleotide
gatcttcttcgttccttcga

SEQ ID NO: 8989 - DNA, 20 bp, Artificial Sequence
  Synthetic polynucleotide
ggatgataccatagacgacg

SEQ ID NO: 8990 - DNA, 20 bp, Artificial Sequence
  Synthetic polynucleotide
ctttggatgagagggaacaa

SEQ ID NO: 8991 - DNA, 20 bp, Artificial Sequence
  Synthetic polynucleotide
ccggtatcagaaaaacgttg

SEQ ID NO: 8992 - DNA, 20 bp, Artificial Sequence
  Synthetic polynucleotide
cgtgtactggacctcattag

SEQ ID NO: 8993 - DNA, 20 bp, Artificial Sequence
  Synthetic polynucleotide
gaggagaagtaggagctaca

SEQ ID NO: 8994 - DNA, 20 bp, Artificial Sequence
  Synthetic polynucleotide
cctacagattgagctgtacc

SEQ ID NO: 8995 - DNA, 20 bp, Artificial Sequence
  Synthetic polynucleotide
gcaaatggaggaggaactta

SEQ ID NO: 8996 - DNA, 20 bp, Artificial Sequence
  Synthetic polynucleotide
tatcgtcgaccgctttatac

SEQ ID NO: 8997 - DNA, 20 bp, Artificial Sequence
  Synthetic polynucleotide
aaaagaaggagtaactgggg

SEQ ID NO: 8998 - DNA, 20 bp, Artificial Sequence
  Synthetic polynucleotide
atccatttttgtcctggtga

SEQ ID NO: 8999 - DNA, 20 bp, Artificial Sequence
  Synthetic polynucleotide
tctcaatggttcaacgacat

SEQ ID NO: 9000 - DNA, 20 bp, Artificial Sequence
  Synthetic polynucleotide
tctccatgtcgttgatgttt

SEQ ID NO: 9001 - DNA, 20 bp, Artificial Sequence
  Synthetic polynucleotide
ttctttcttttcttctgcgg

SEQ ID NO: 9002 - DNA, 20 bp, Artificial Sequence
  Synthetic polynucleotide
cgaaaaggtcaagaaggtct

SEQ ID NO: 9003 - DNA, 20 bp, Artificial Sequence
  Synthetic polynucleotide
agcggtactcaagaaacatt

SEQ ID NO: 9004 - DNA, 20 bp, Artificial Sequence
  Synthetic polynucleotide
gatctcgccgctaatattct

SEQ ID NO: 9005 - DNA, 20 bp, Artificial Sequence
  Synthetic polynucleotide
tagcctcattgagtactcca

SEQ ID NO: 9006 - DNA, 20 bp, Artificial Sequence
  Synthetic polynucleotide
acatttgcttcaattgcgaa

SEQ ID NO: 9007 - DNA, 20 bp, Artificial Sequence
  Synthetic polynucleotide
ttgctgtttttaggactgga

SEQ ID NO: 9008 - DNA, 20 bp, Artificial Sequence
  Synthetic polynucleotide
cacataaacagctcgaaagg

SEQ ID NO: 9009 - DNA, 20 bp, Artificial Sequence
  Synthetic polynucleotide
tatccaacaaaacgcaaacc

SEQ ID NO: 9010 - DNA, 20 bp, Artificial Sequence
  Synthetic polynucleotide
ccatatccaattgcgagaac

SEQ ID NO: 9011 - DNA, 20 bp, Artificial Sequence
  Synthetic polynucleotide
agaaggaaacgtggctaatt

SEQ ID NO: 9012 - DNA, 20 bp, Artificial Sequence
  Synthetic polynucleotide
ggtacccgaatattgggtac

SEQ ID NO: 9013 - DNA, 20 bp, Artificial Sequence
  Synthetic polynucleotide
gagaaaacgttcgaagacac

SEQ ID NO: 9014 - DNA, 20 bp, Artificial Sequence
  Synthetic polynucleotide
ctggatctcgatctcctttg

SEQ ID NO: 9015 - DNA, 20 bp, Artificial Sequence
  Synthetic polynucleotide
ctgcctcactacaagtttct

SEQ ID NO: 9016 - DNA, 20 bp, Artificial Sequence
  Synthetic polynucleotide
tctgccaaattcgagaagaa

SEQ ID NO: 9017 - DNA, 20 bp, Artificial Sequence
  Synthetic polynucleotide
agcaggacatcaacatcaat

SEQ ID NO: 9018 - DNA, 20 bp, Artificial Sequence
  Synthetic polynucleotide
ttcctgttccagtttttcca

SEQ ID NO: 9019 - DNA, 20 bp, Artificial Sequence
  Synthetic polynucleotide
aaagcttcaaaatagcgacg

SEQ ID NO: 9020 - DNA, 20 bp, Artificial Sequence
  Synthetic polynucleotide
attgatgcagttcctcatgt

SEQ ID NO: 9021 - DNA, 20 bp, Artificial Sequence
  Synthetic polynucleotide
tcactagtatggctggatca

SEQ ID NO: 9022 - DNA, 20 bp, Artificial Sequence
  Synthetic polynucleotide
gtggccattatgacaattgg

SEQ ID NO: 9023 - DNA, 20 bp, Artificial Sequence
  Synthetic polynucleotide
gggaaattatcttcgcctct

SEQ ID NO: 9024 - DNA, 20 bp, Artificial Sequence
  Synthetic polynucleotide
aattctgcgcaaagtttcaa

SEQ ID NO: 9025 - DNA, 20 bp, Artificial Sequence
  Synthetic polynucleotide
atcaattcccggaagtgtac

SEQ ID NO: 9026 - DNA, 20 bp, Artificial Sequence
  Synthetic polynucleotide
ggtggcattctcgaatactt

SEQ ID NO: 9027 - DNA, 20 bp, Artificial Sequence
  Synthetic polynucleotide
gcagcaaattgagagaagtc

SEQ ID NO: 9028 - DNA, 20 bp, Artificial Sequence
  Synthetic polynucleotide
ttcatggtctcgatgttgtt

SEQ ID NO: 9029 - DNA, 20 bp, Artificial Sequence
  Synthetic polynucleotide
cggaaataaatgccagttcc

SEQ ID NO: 9030 - DNA, 20 bp, Artificial Sequence
  Synthetic polynucleotide
ggccaacatggaaaaattga

SEQ ID NO: 9031 - DNA, 20 bp, Artificial Sequence
  Synthetic polynucleotide
tattggctccgatattgtgg

SEQ ID NO: 9032 - DNA, 20 bp, Artificial Sequence
  Synthetic polynucleotide
tcggcgaaattcaatttagc

SEQ ID NO: 9033 - DNA, 20 bp, Artificial Sequence
  Synthetic polynucleotide
gttcgagtgcatagaggaat

SEQ ID NO: 9034 - DNA, 19 bp, Artificial Sequence
  Synthetic polynucleotide
agtctcggatgtttggttg

SEQ ID NO: 9035 - DNA, 20 bp, Artificial Sequence
  Synthetic polynucleotide
aacgcttggtctaggtttag

SEQ ID NO: 9036 - DNA, 20 bp, Artificial Sequence
  Synthetic polynucleotide
tttagcaccagtcagaacaa

SEQ ID NO: 9037 - DNA, 20 bp, Artificial Sequence
  Synthetic polynucleotide
tccaacaaaatcccctttca

SEQ ID NO: 9038 - DNA, 20 bp, Artificial Sequence
  Synthetic polynucleotide
agctctagcctgatctgtag

SEQ ID NO: 9039 - DNA, 20 bp, Artificial Sequence
  Synthetic polynucleotide
agaaatacgagaagtccagc

SEQ ID NO: 9040 - DNA, 20 bp, Artificial Sequence
  Synthetic polynucleotide
atctctttctgtcgctgatc

SEQ ID NO: 9041 - DNA, 20 bp, Artificial Sequence
  Synthetic polynucleotide
agtacagcgatagagagagg

SEQ ID NO: 9042 - DNA, 20 bp, Artificial Sequence
  Synthetic polynucleotide
ccttattttgcctgctcttc

SEQ ID NO: 9043 - DNA, 20 bp, Artificial Sequence
  Synthetic polynucleotide
agtaaatcacgccagaaact

SEQ ID NO: 9044 - DNA, 20 bp, Artificial Sequence
  Synthetic polynucleotide
cgggttatttccaaatcagc

SEQ ID NO: 9045 - DNA, 20 bp, Artificial Sequence
  Synthetic polynucleotide
ggagatccagctgaaatagg

SEQ ID NO: 9046 - DNA, 20 bp, Artificial Sequence
  Synthetic polynucleotide
atgaccatctgttgctcttt

SEQ ID NO: 9047 - DNA, 20 bp, Artificial Sequence
  Synthetic polynucleotide
caggacaagttattacggct

SEQ ID NO: 9048 - DNA, 20 bp, Artificial Sequence
  Synthetic polynucleotide
cgaccggaatcataatcagt

SEQ ID NO: 9049 - DNA, 20 bp, Artificial Sequence
  Synthetic polynucleotide
aaatggaacttcatcctccc

SEQ ID NO: 9050 - DNA, 20 bp, Artificial Sequence
  Synthetic polynucleotide
accacgatattactgaaccg

SEQ ID NO: 9051 - DNA, 20 bp, Artificial Sequence
  Synthetic polynucleotide
tgcgtgagaacctattatgg

SEQ ID NO: 9052 - DNA, 20 bp, Artificial Sequence
  Synthetic polynucleotide
cttgaacagcttagtggact

SEQ ID NO: 9053 - DNA, 20 bp, Artificial Sequence
  Synthetic polynucleotide
ctttggcagtgaaaaaggtc

SEQ ID NO: 9054 - DNA, 20 bp, Artificial Sequence
  Synthetic polynucleotide
gatttcgatccgaggatacc

SEQ ID NO: 9055 - DNA, 20 bp, Artificial Sequence
  Synthetic polynucleotide
cataaaggaatacggccaga

SEQ ID NO: 9056 - DNA, 20 bp, Artificial Sequence
  Synthetic polynucleotide
ggcaggccaatatgaatttc

SEQ ID NO: 9057 - DNA, 20 bp, Artificial Sequence
  Synthetic polynucleotide
cttacatagccgtaaccgaa

SEQ ID NO: 9058 - DNA, 20 bp, Artificial Sequence
  Synthetic polynucleotide
ttactcggattccaatcgtc

SEQ ID NO: 9059 - DNA, 20 bp, Artificial Sequence
  Synthetic polynucleotide
gaccaactctacgacatacc

SEQ ID NO: 9060 - DNA, 20 bp, Artificial Sequence
  Synthetic polynucleotide
tttgtacagccaatacggaa

SEQ ID NO: 9061 - DNA, 20 bp, Artificial Sequence
  Synthetic polynucleotide
tatcggcacctttaaagctt

SEQ ID NO: 9062 - DNA, 18 bp, Artificial Sequence
  Synthetic polynucleotide
ggacccctcatacccatc

SEQ ID NO: 9063 - DNA, 20 bp, Artificial Sequence
  Synthetic polynucleotide
tcggatgtccatctctactt

SEQ ID NO: 9064 - DNA, 20 bp, Artificial Sequence
  Synthetic polynucleotide
tccaagggtcgatgaaaaat

SEQ ID NO: 9065 - DNA, 20 bp, Artificial Sequence
  Synthetic polynucleotide
ataacgaggaggcggatata

SEQ ID NO: 9066 - DNA, 20 bp, Artificial Sequence
  Synthetic polynucleotide
gacgatacgttcacgatttg

SEQ ID NO: 9067 - DNA, 20 bp, Artificial Sequence
  Synthetic polynucleotide
tagagagggaattggagagg

SEQ ID NO: 9068 - DNA, 20 bp, Artificial Sequence
  Synthetic polynucleotide
ctgcttttagtacttgcagc

SEQ ID NO: 9069 - DNA, 20 bp, Artificial Sequence
  Synthetic polynucleotide
cttaaacggctacgaaatcg

SEQ ID NO: 9070 - DNA, 20 bp, Artificial Sequence
  Synthetic polynucleotide
ttatccggtttcgaatctcc

SEQ ID NO: 9071 - DNA, 20 bp, Artificial Sequence
  Synthetic polynucleotide
cagactgaaagaaatgcgag

SEQ ID NO: 9072 - DNA, 20 bp, Artificial Sequence
  Synthetic polynucleotide
aatagcgtcgatttcatcca

SEQ ID NO: 9073 - DNA, 20 bp, Artificial Sequence
  Synthetic polynucleotide
ccatggaagccatatctcac

SEQ ID NO: 9074 - DNA, 20 bp, Artificial Sequence
  Synthetic polynucleotide
agttcttccacttctttgct

SEQ ID NO: 9075 - DNA, 20 bp, Artificial Sequence
  Synthetic polynucleotide
aggtcttacgcctatcgata

SEQ ID NO: 9076 - DNA, 20 bp, Artificial Sequence
  Synthetic polynucleotide
taattaccggttcgcagtag

SEQ ID NO: 9077 - DNA, 20 bp, Artificial Sequence
  Synthetic polynucleotide
caaccatcagtaccagaaca

SEQ ID NO: 9078 - DNA, 20 bp, Artificial Sequence
  Synthetic polynucleotide
aagtcttacttgacctgcag

SEQ ID NO: 9079 - DNA, 20 bp, Artificial Sequence
  Synthetic polynucleotide
ccatttccaccattgtagga

SEQ ID NO: 9080 - DNA, 20 bp, Artificial Sequence
  Synthetic polynucleotide
tctcctcgcttttgattgaa

SEQ ID NO: 9081 - DNA, 18 bp, Artificial Sequence
  Synthetic polynucleotide
atacaagcccaaacggtg

SEQ ID NO: 9082 - DNA, 20 bp, Artificial Sequence
  Synthetic polynucleotide
aatataaaccgtagcacccc

SEQ ID NO: 9083 - DNA, 20 bp, Artificial Sequence
  Synthetic polynucleotide
ggaattgtgttcgatgcaat

SEQ ID NO: 9084 - DNA, 20 bp, Artificial Sequence
  Synthetic polynucleotide
accgtattcgtttagtaggc

SEQ ID NO: 9085 - DNA, 20 bp, Artificial Sequence
  Synthetic polynucleotide
gttacaacagaagaacagcg

SEQ ID NO: 9086 - DNA, 20 bp, Artificial Sequence
  Synthetic polynucleotide
aacttcatgcgagtacagtt

SEQ ID NO: 9087 - DNA, 20 bp, Artificial Sequence
  Synthetic polynucleotide
agcccacattggatgaatta

SEQ ID NO: 9088 - DNA, 20 bp, Artificial Sequence
  Synthetic polynucleotide
ttccgaaattggtgtctctt

SEQ ID NO: 9089 - DNA, 20 bp, Artificial Sequence
  Synthetic polynucleotide
gggcccacaatttagaagat

SEQ ID NO: 9090 - DNA, 20 bp, Artificial Sequence
  Synthetic polynucleotide
ttttgaaaaaggccattccg

SEQ ID NO: 9091 - DNA, 20 bp, Artificial Sequence
  Synthetic polynucleotide
catcttcgcatatggtttcg

SEQ ID NO: 9092 - DNA, 20 bp, Artificial Sequence
  Synthetic polynucleotide
acggtgaagttattctctcg

SEQ ID NO: 9093 - DNA, 20 bp, Artificial Sequence
  Synthetic polynucleotide
caacagtcgagtctcttagg

SEQ ID NO: 9094 - DNA, 20 bp, Artificial Sequence
  Synthetic polynucleotide
ttattagccatagcagccag

SEQ ID NO: 9095 - DNA, 20 bp, Artificial Sequence
  Synthetic polynucleotide
agagctagacatggaggatt

SEQ ID NO: 9096 - DNA, 20 bp, Artificial Sequence
  Synthetic polynucleotide
gtctgagcatcgaatctctt

SEQ ID NO: 9097 - DNA, 20 bp, Artificial Sequence
  Synthetic polynucleotide
gacgataaaaaccatgctgg

SEQ ID NO: 9098 - DNA, 20 bp, Artificial Sequence
  Synthetic polynucleotide
gcgtgaaatcgtttttgatg

SEQ ID NO: 9099 - DNA, 20 bp, Artificial Sequence
  Synthetic polynucleotide
tgtgtgataaggcgaaagaa

SEQ ID NO: 9100 - DNA, 20 bp, Artificial Sequence
  Synthetic polynucleotide
agcgcatcatctaattccat

SEQ ID NO: 9101 - DNA, 20 bp, Artificial Sequence
  Synthetic polynucleotide
actatcgagaacgttaaggc

SEQ ID NO: 9102 - DNA, 20 bp, Artificial Sequence
  Synthetic polynucleotide
agacaatgttctgccatctt

SEQ ID NO: 9103 - DNA, 20 bp, Artificial Sequence
  Synthetic polynucleotide
gaggaatacagatcgttgct

SEQ ID NO: 9104 - DNA, 20 bp, Artificial Sequence
  Synthetic polynucleotide
tgcgtacaatcatgatagca

SEQ ID NO: 9105 - DNA, 20 bp, Artificial Sequence
  Synthetic polynucleotide
ggcgagcaattagaagtaga

SEQ ID NO: 9106 - DNA, 20 bp, Artificial Sequence
  Synthetic polynucleotide
cagacattccatccatttgc

SEQ ID NO: 9107 - DNA, 20 bp, Artificial Sequence
  Synthetic polynucleotide
accctttcagagacgatcta

SEQ ID NO: 9108 - DNA, 20 bp, Artificial Sequence
  Synthetic polynucleotide
aacatcttactcgatcctgc

SEQ ID NO: 9109 - DNA, 20 bp, Artificial Sequence
  Synthetic polynucleotide
aagaattgggcaacaaagtg

SEQ ID NO: 9110 - DNA, 20 bp, Artificial Sequence
  Synthetic polynucleotide
cgatgaataatacacccggt

SEQ ID NO: 9111 - DNA, 20 bp, Artificial Sequence
  Synthetic polynucleotide
atccggacttttggcttatt

SEQ ID NO: 9112 - DNA, 20 bp, Artificial Sequence
  Synthetic polynucleotide
tgtaatcttccgctttcaca

SEQ ID NO: 9113 - DNA, 20 bp, Artificial Sequence
  Synthetic polynucleotide
gaacaacgggacaaacaaat

SEQ ID NO: 9114 - DNA, 20 bp, Artificial Sequence
  Synthetic polynucleotide
catcaccggtatcgaaatct

SEQ ID NO: 9115 - DNA, 20 bp, Artificial Sequence
  Synthetic polynucleotide
tgaggacgacaaagacaaat

SEQ ID NO: 9116 - DNA, 20 bp, Artificial Sequence
  Synthetic polynucleotide
tttctcctcctttttgcctt

SEQ ID NO: 9117 - DNA, 20 bp, Artificial Sequence
  Synthetic polynucleotide
agggagtatccgatatagcc

SEQ ID NO: 9118 - DNA, 20 bp, Artificial Sequence
  Synthetic polynucleotide
ttcctgttgttgcatttgac

SEQ ID NO: 9119 - DNA, 20 bp, Artificial Sequence
  Synthetic polynucleotide
cagattaatccgtacgctga

SEQ ID NO: 9120 - DNA, 20 bp, Artificial Sequence
  Synthetic polynucleotide
aaatatccctttctgcagcc

SEQ ID NO: 9121 - DNA, 20 bp, Artificial Sequence
  Synthetic polynucleotide
catgacctacaagtgctact

SEQ ID NO: 9122 - DNA, 20 bp, Artificial Sequence
  Synthetic polynucleotide
ccctaacgtaaaccggttta

SEQ ID NO: 9123 - DNA, 20 bp, Artificial Sequence
  Synthetic polynucleotide
aaagttgcgatgactacact

SEQ ID NO: 9124 - DNA, 20 bp, Artificial Sequence
  Synthetic polynucleotide
gtaaactcctcttggcttca

SEQ ID NO: 9125 - DNA, 20 bp, Artificial Sequence
  Synthetic polynucleotide
aaaggtgagaagaaacggtt

SEQ ID NO: 9126 - DNA, 20 bp, Artificial Sequence
  Synthetic polynucleotide
agtgaaaatgaaaagcgtgg

SEQ ID NO: 9127 - DNA, 20 bp, Artificial Sequence
  Synthetic polynucleotide
ctcgaaaattctatcgcagc

SEQ ID NO: 9128 - DNA, 20 bp, Artificial Sequence
  Synthetic polynucleotide
tctgcctcgtctatgatttg

SEQ ID NO: 9129 - DNA, 20 bp, Artificial Sequence
  Synthetic polynucleotide
gccgtcataatagccctaaa

SEQ ID NO: 9130 - DNA, 19 bp, Artificial Sequence
  Synthetic polynucleotide
gattccctcaaaggatcgg

SEQ ID NO: 9131 - DNA, 20 bp, Artificial Sequence
  Synthetic polynucleotide
gtaaataatgccttcgagcg

SEQ ID NO: 9132 - DNA, 20 bp, Artificial Sequence
  Synthetic polynucleotide
cttcttccattcgtttgctc

SEQ ID NO: 9133 - DNA, 20 bp, Artificial Sequence
  Synthetic polynucleotide
gcggtttagacgacaaagta

SEQ ID NO: 9134 - DNA, 19 bp, Artificial Sequence
  Synthetic polynucleotide
catcatgccggtgattaga

SEQ ID NO: 9135 - DNA, 20 bp, Artificial Sequence
  Synthetic polynucleotide
ccaagctccgttacttagat

SEQ ID NO: 9136 - DNA, 20 bp, Artificial Sequence
  Synthetic polynucleotide
cagcaataagacccacctta

SEQ ID NO: 9137 - DNA, 18 bp, Artificial Sequence
  Synthetic polynucleotide
aacttgctacgaaggctg

SEQ ID NO: 9138 - DNA, 20 bp, Artificial Sequence
  Synthetic polynucleotide
catgtatagcgcacaagttc

SEQ ID NO: 9139 - DNA, 20 bp, Artificial Sequence
  Synthetic polynucleotide
ggctgatctccttactgatg

SEQ ID NO: 9140 - DNA, 20 bp, Artificial Sequence
  Synthetic polynucleotide
tataagcgctttgtcatcga

SEQ ID NO: 9141 - DNA, 20 bp, Artificial Sequence
  Synthetic polynucleotide
ttcgatcaccccattcaatt

SEQ ID NO: 9142 - DNA, 20 bp, Artificial Sequence
  Synthetic polynucleotide
taacgtcgggattcatcttc

SEQ ID NO: 9143 - DNA, 20 bp, Artificial Sequence
  Synthetic polynucleotide
tagctgattgtggtttcgaa

SEQ ID NO: 9144 - DNA, 20 bp, Artificial Sequence
  Synthetic polynucleotide
caccacctgattaaactcca

SEQ ID NO: 9145 - DNA, 20 bp, Artificial Sequence
  Synthetic polynucleotide
gttcttgtactacttgggca

SEQ ID NO: 9146 - DNA, 20 bp, Artificial Sequence
  Synthetic polynucleotide
agttcctttccatacgcatt

SEQ ID NO: 9147 - DNA, 20 bp, Artificial Sequence
  Synthetic polynucleotide
gtatacgagaagatacggcc

SEQ ID NO: 9148 - DNA, 20 bp, Artificial Sequence
  Synthetic polynucleotide
tcgctttggatttttcatcg

SEQ ID NO: 9149 - DNA, 20 bp, Artificial Sequence
  Synthetic polynucleotide
aggaagttcgaattaggtcg

SEQ ID NO: 9150 - DNA, 19 bp, Artificial Sequence
  Synthetic polynucleotide
attgtccaggtcttgatgc

SEQ ID NO: 9151 - DNA, 20 bp, Artificial Sequence
  Synthetic polynucleotide
gtcatgggtcttatgctagg

SEQ ID NO: 9152 - DNA, 20 bp, Artificial Sequence
  Synthetic polynucleotide
tccactttctcctccaaatg

SEQ ID NO: 9153 - DNA, 20 bp, Artificial Sequence
  Synthetic polynucleotide
tggtcaaacccatggataag

SEQ ID NO: 9154 - DNA, 20 bp, Artificial Sequence
  Synthetic polynucleotide
agtaaagcgggatccaaaat

SEQ ID NO: 9155 - DNA, 20 bp, Artificial Sequence
  Synthetic polynucleotide
gttgaagtctgctttcgatt

SEQ ID NO: 9156 - DNA, 20 bp, Artificial Sequence
  Synthetic polynucleotide
tccaacttttcccctctttc

SEQ ID NO: 9157 - DNA, 20 bp, Artificial Sequence
  Synthetic polynucleotide
tggaatatgccattgaagct

SEQ ID NO: 9158 - DNA, 20 bp, Artificial Sequence
  Synthetic polynucleotide
atatcctttggcgtcattgt

SEQ ID NO: 9159 - DNA, 20 bp, Artificial Sequence
  Synthetic polynucleotide
gaggttcttgaagaccagag

SEQ ID NO: 9160 - DNA, 20 bp, Artificial Sequence
  Synthetic polynucleotide
ggatggatcagaatagcctg

SEQ ID NO: 9161 - DNA, 20 bp, Artificial Sequence
  Synthetic polynucleotide
ctcgatgtaccccattaagg

SEQ ID NO: 9162 - DNA, 20 bp, Artificial Sequence
  Synthetic polynucleotide
cgaagttctccaggtagatg

SEQ ID NO: 9163 - DNA, 20 bp, Artificial Sequence
  Synthetic polynucleotide
gccttctataacttcccagg

SEQ ID NO: 9164 - DNA, 20 bp, Artificial Sequence
  Synthetic polynucleotide
attctcctcgacagaaatcg

SEQ ID NO: 9165 - DNA, 20 bp, Artificial Sequence
  Synthetic polynucleotide
tccgaattgcaaaatcttcg

SEQ ID NO: 9166 - DNA, 20 bp, Artificial Sequence
  Synthetic polynucleotide
cttccacttcatcaaaggga

SEQ ID NO: 9167 - DNA, 20 bp, Artificial Sequence
  Synthetic polynucleotide
cccaaagatgaagatggtga

SEQ ID NO: 9168 - DNA, 20 bp, Artificial Sequence
  Synthetic polynucleotide
caaatccatcaggcattcac

SEQ ID NO: 9169 - DNA, 20 bp, Artificial Sequence
  Synthetic polynucleotide
aaaccgactttaagggatcc

SEQ ID NO: 9170 - DNA, 20 bp, Artificial Sequence
  Synthetic polynucleotide
atacttcgtctgtatggcac

SEQ ID NO: 9171 - DNA, 20 bp, Artificial Sequence
  Synthetic polynucleotide
ccttgttaaaagagctgcag

SEQ ID NO: 9172 - DNA, 20 bp, Artificial Sequence
  Synthetic polynucleotide
caaacactatcaggacacca

SEQ ID NO: 9173 - DNA, 20 bp, Artificial Sequence
  Synthetic polynucleotide
cgagcagaaaatcaagaacc

SEQ ID NO: 9174 - DNA, 20 bp, Artificial Sequence
  Synthetic polynucleotide
gccctttcataaccaggtta

SEQ ID NO: 9175 - DNA, 20 bp, Artificial Sequence
  Synthetic polynucleotide
ctgagaatccacaccaagaa

SEQ ID NO: 9176 - DNA, 20 bp, Artificial Sequence
  Synthetic polynucleotide
ggacgtaatatagcgggatc

SEQ ID NO: 9177 - DNA, 21 bp, Artificial Sequence
  Synthetic polynucleotide
gcgacttgatagatttagtgc

SEQ ID NO: 9178 - DNA, 20 bp, Artificial Sequence
  Synthetic polynucleotide
cgacctcaagctattgacta

SEQ ID NO: 9179 - DNA, 20 bp, Artificial Sequence
  Synthetic polynucleotide
tcaggatttcaacacgatgt

SEQ ID NO: 9180 - DNA, 20 bp, Artificial Sequence
  Synthetic polynucleotide
tccatgaggatttcattgca

SEQ ID NO: 9181 - DNA, 20 bp, Artificial Sequence
  Synthetic polynucleotide
tttaaggccccaattagacc

SEQ ID NO: 9182 - DNA, 20 bp, Artificial Sequence
  Synthetic polynucleotide
ttcagtccagatcacgaatc

SEQ ID NO: 9183 - DNA, 20 bp, Artificial Sequence
  Synthetic polynucleotide
cgaggaagaggaagaagatg

SEQ ID NO: 9184 - DNA, 20 bp, Artificial Sequence
  Synthetic polynucleotide
cagctttcttcggatgtttc

SEQ ID NO: 9185 - DNA, 20 bp, Artificial Sequence
  Synthetic polynucleotide
gtagctcacttggtaaacca

SEQ ID NO: 9186 - DNA, 20 bp, Artificial Sequence
  Synthetic polynucleotide
tctcatatgtcctttgctcg

SEQ ID NO: 9187 - DNA, 20 bp, Artificial Sequence
  Synthetic polynucleotide
cccagacactttccaatgta

SEQ ID NO: 9188 - DNA, 20 bp, Artificial Sequence
  Synthetic polynucleotide
gttgcgcatgtgatctttaa

SEQ ID NO: 9189 - DNA, 20 bp, Artificial Sequence
  Synthetic polynucleotide
acaagcagtaataggcacaa

SEQ ID NO: 9190 - DNA, 20 bp, Artificial Sequence
  Synthetic polynucleotide
caagtgctcgtaaacaactc

SEQ ID NO: 9191 - DNA, 20 bp, Artificial Sequence
  Synthetic polynucleotide
tagaaaccatcgatctgcag

SEQ ID NO: 9192 - DNA, 20 bp, Artificial Sequence
  Synthetic polynucleotide
gggattaaacataggaggcc

SEQ ID NO: 9193 - DNA, 20 bp, Artificial Sequence
  Synthetic polynucleotide
taacctgcgaaacgataacc

SEQ ID NO: 9194 - DNA, 20 bp, Artificial Sequence
  Synthetic polynucleotide
gctcgtagaattgcagactt

SEQ ID NO: 9195 - DNA, 20 bp, Artificial Sequence
  Synthetic polynucleotide
tattcgcaacattcagcaac

SEQ ID NO: 9196 - DNA, 20 bp, Artificial Sequence
  Synthetic polynucleotide
catcttcatcagacaccgat

SEQ ID NO: 9197 - DNA, 20 bp, Artificial Sequence
  Synthetic polynucleotide
tgatcggatgactaacgaac

SEQ ID NO: 9198 - DNA, 20 bp, Artificial Sequence
  Synthetic polynucleotide
caatgatgtaattgtggccc

SEQ ID NO: 9199 - DNA, 20 bp, Artificial Sequence
  Synthetic polynucleotide
cgttggtaatcctcgaagat

SEQ ID NO: 9200 - DNA, 20 bp, Artificial Sequence
  Synthetic polynucleotide
cgcattgataggccaaaaat

SEQ ID NO: 9201 - DNA, 20 bp, Artificial Sequence
  Synthetic polynucleotide
tcgaattcacttgcagctat

SEQ ID NO: 9202 - DNA, 20 bp, Artificial Sequence
  Synthetic polynucleotide
tgttgatgtttttgatggcc

SEQ ID NO: 9203 - DNA, 20 bp, Artificial Sequence
  Synthetic polynucleotide
atcagacgcagctactaaag

SEQ ID NO: 9204 - DNA, 20 bp, Artificial Sequence
  Synthetic polynucleotide
gaacagcaattgcacgaata

SEQ ID NO: 9205 - DNA, 20 bp, Artificial Sequence
  Synthetic polynucleotide
ggccctatttagcttcagaa

SEQ ID NO: 9206 - DNA, 20 bp, Artificial Sequence
  Synthetic polynucleotide
tcaacaaagcctgttcgata

SEQ ID NO: 9207 - DNA, 20 bp, Artificial Sequence
  Synthetic polynucleotide
tacaggcaaaacaactttcg

SEQ ID NO: 9208 - DNA, 20 bp, Artificial Sequence
  Synthetic polynucleotide
ccattacaacttcaggaggt

SEQ ID NO: 9209 - DNA, 20 bp, Artificial Sequence
  Synthetic polynucleotide
ataagtctctgtttcgccag

SEQ ID NO: 9210 - DNA, 20 bp, Artificial Sequence
  Synthetic polynucleotide
aaataaccgagccagtagtg

SEQ ID NO: 9211 - DNA, 20 bp, Artificial Sequence
  Synthetic polynucleotide
agaaacgaggcgtagattac

SEQ ID NO: 9212 - DNA, 20 bp, Artificial Sequence
  Synthetic polynucleotide
cttcggcgttaatattcagc

SEQ ID NO: 9213 - DNA, 20 bp, Artificial Sequence
  Synthetic polynucleotide
gctcatcctgataagctgaa

SEQ ID NO: 9214 - DNA, 20 bp, Artificial Sequence
  Synthetic polynucleotide
tgccttcaggacatttttct

SEQ ID NO: 9215 - DNA, 20 bp, Artificial Sequence
  Synthetic polynucleotide
aagagatcgtcgtttctcag

SEQ ID NO: 9216 - DNA, 20 bp, Artificial Sequence
  Synthetic polynucleotide
tcggtttcgcattgttttag

SEQ ID NO: 9217 - DNA, 20 bp, Artificial Sequence
  Synthetic polynucleotide
agatggtaagctgaaacctg

SEQ ID NO: 9218 - DNA, 20 bp, Artificial Sequence
  Synthetic polynucleotide
tcttggcttttccaggattt

SEQ ID NO: 9219 - DNA, 20 bp, Artificial Sequence
  Synthetic polynucleotide
cccaaagatgaagatggtga

SEQ ID NO: 9220 - DNA, 20 bp, Artificial Sequence
  Synthetic polynucleotide
caaatccatcaggcattcac

SEQ ID NO: 9221 - DNA, 20 bp, Artificial Sequence
  Synthetic polynucleotide
ttaacttccaacaacctgct

SEQ ID NO: 9222 - DNA, 20 bp, Artificial Sequence
  Synthetic polynucleotide
gtgagaattctttgcgaagg

SEQ ID NO: 9223 - DNA, 20 bp, Artificial Sequence
  Synthetic polynucleotide
gcgaaaatttggataccctg

SEQ ID NO: 9224 - DNA, 20 bp, Artificial Sequence
  Synthetic polynucleotide
atggtaggtgcagtaggtat

SEQ ID NO: 9225 - DNA, 20 bp, Artificial Sequence
  Synthetic polynucleotide
attggtccactaggtttgtc

SEQ ID NO: 9226 - DNA, 20 bp, Artificial Sequence
  Synthetic polynucleotide
ttgtttgccatcaatgacac

SEQ ID NO: 9227 - DNA, 20 bp, Artificial Sequence
  Synthetic polynucleotide
ctagagaagttccacgaagg

SEQ ID NO: 9228 - DNA, 20 bp, Artificial Sequence
  Synthetic polynucleotide
cccgtttatgtacgtctcat

SEQ ID NO: 9229 - DNA, 20 bp, Artificial Sequence
  Synthetic polynucleotide
cgatgtaaggaagcttctga

SEQ ID NO: 9230 - DNA, 20 bp, Artificial Sequence
  Synthetic polynucleotide
agagccttaaacgtcgtatc

SEQ ID NO: 9231 - DNA, 20 bp, Artificial Sequence
  Synthetic polynucleotide
gttgttggatacgtcgtaga

SEQ ID NO: 9232 - DNA, 20 bp, Artificial Sequence
  Synthetic polynucleotide
cgaatctttgtcgcaatcaa

SEQ ID NO: 9233 - DNA, 20 bp, Artificial Sequence
  Synthetic polynucleotide
ctgaagctgaaaaggtcaag

SEQ ID NO: 9234 - DNA, 19 bp, Artificial Sequence
  Synthetic polynucleotide
tacctttcttttgctcggc

SEQ ID NO: 9235 - DNA, 20 bp, Artificial Sequence
  Synthetic polynucleotide
cagatcgaacagagtatgca

SEQ ID NO: 9236 - DNA, 20 bp, Artificial Sequence
  Synthetic polynucleotide
gatattctggacgtcagctt

SEQ ID NO: 9237 - DNA, 20 bp, Artificial Sequence
  Synthetic polynucleotide
cagcttcaactggacttagt

SEQ ID NO: 9238 - DNA, 20 bp, Artificial Sequence
  Synthetic polynucleotide
ggagtcctgcattttactga

SEQ ID NO: 9239 - DNA, 20 bp, Artificial Sequence
  Synthetic polynucleotide
ccgggaaattgctgttttta

SEQ ID NO: 9240 - DNA, 20 bp, Artificial Sequence
  Synthetic polynucleotide
gaatcgagcacataaacagc

SEQ ID NO: 9241 - DNA, 20 bp, Artificial Sequence
  Synthetic polynucleotide
caacctgttgtactccttca

SEQ ID NO: 9242 - DNA, 20 bp, Artificial Sequence
  Synthetic polynucleotide
ccaacgtttgattctgatgg

SEQ ID NO: 9243 - DNA, 20 bp, Artificial Sequence
  Synthetic polynucleotide
catcaagaagtccctgaaca

SEQ ID NO: 9244 - DNA, 20 bp, Artificial Sequence
  Synthetic polynucleotide
atactgaggaagctctggat

SEQ ID NO: 9245 - DNA, 20 bp, Artificial Sequence
  Synthetic polynucleotide
cgataaaacggtgtctttgg

SEQ ID NO: 9246 - DNA, 20 bp, Artificial Sequence
  Synthetic polynucleotide
cgattttacaatgcagcctt

SEQ ID NO: 9247 - DNA, 20 bp, Artificial Sequence
  Synthetic polynucleotide
ttcgtcgaaagttgaagagt

SEQ ID NO: 9248 - DNA, 20 bp, Artificial Sequence
  Synthetic polynucleotide
ctaaactgaggactgttgct

SEQ ID NO: 9249 - DNA, 20 bp, Artificial Sequence
  Synthetic polynucleotide
cggctatcgagaaacctaaa

SEQ ID NO: 9250 - DNA, 20 bp, Artificial Sequence
  Synthetic polynucleotide
tatttcttggaggtttcgca

SEQ ID NO: 9251 - DNA, 20 bp, Artificial Sequence
  Synthetic polynucleotide
gacgcaggctattagaaaga

SEQ ID NO: 9252 - DNA, 20 bp, Artificial Sequence
  Synthetic polynucleotide
aattccttctcgtcgtatgg

SEQ ID NO: 9253 - DNA, 20 bp, Artificial Sequence
  Synthetic polynucleotide
ttatctgcgactgttcagag

SEQ ID NO: 9254 - DNA, 20 bp, Artificial Sequence
  Synthetic polynucleotide
aattctgcgcaaagtttcaa

SEQ ID NO: 9255 - DNA, 20 bp, Artificial Sequence
  Synthetic polynucleotide
tcatcagctacaccactaac

SEQ ID NO: 9256 - DNA, 19 bp, Artificial Sequence
  Synthetic polynucleotide
atcgaacacctgcttcaag

SEQ ID NO: 9257 - DNA, 20 bp, Artificial Sequence
  Synthetic polynucleotide
ttcatattgcctaccgatgg

SEQ ID NO: 9258 - DNA, 20 bp, Artificial Sequence
  Synthetic polynucleotide
tccaaattaatggccgtgta

SEQ ID NO: 9259 - DNA, 20 bp, Artificial Sequence
  Synthetic polynucleotide
cagtatggcgatcagaagaa

SEQ ID NO: 9260 - DNA, 20 bp, Artificial Sequence
  Synthetic polynucleotide
agaagttctgtttcgaacga

SEQ ID NO: 9261 - DNA, 20 bp, Artificial Sequence
  Synthetic polynucleotide
acaaccgaaatacgatttgc

SEQ ID NO: 9262 - DNA, 20 bp, Artificial Sequence
  Synthetic polynucleotide
cacgggtttttgtaatacgg

SEQ ID NO: 9263 - DNA, 20 bp, Artificial Sequence
  Synthetic polynucleotide
atcacgttcgaatgcataga

SEQ ID NO: 9264 - DNA, 20 bp, Artificial Sequence
  Synthetic polynucleotide
gaagtttcggttgtttggtt

SEQ ID NO: 9265 - DNA, 20 bp, Artificial Sequence
  Synthetic polynucleotide
tttaccaaacgccattcaac

SEQ ID NO: 9266 - DNA, 20 bp, Artificial Sequence
  Synthetic polynucleotide
aacaattcgggctcataact

SEQ ID NO: 9267 - DNA, 20 bp, Artificial Sequence
  Synthetic polynucleotide
tacgcagatcaaatgagctt

SEQ ID NO: 9268 - DNA, 20 bp, Artificial Sequence
  Synthetic polynucleotide
ttaagaagatctctggctgc

SEQ ID NO: 9269 - DNA, 20 bp, Artificial Sequence
  Synthetic polynucleotide
gcgaatgggaaaagttagtg

SEQ ID NO: 9270 - DNA, 20 bp, Artificial Sequence
  Synthetic polynucleotide
tttctgcctttgatcgtaca

SEQ ID NO: 9271 - DNA, 19 bp, Artificial Sequence
  Synthetic polynucleotide
gcaatggagccctgataaa

SEQ ID NO: 9272 - DNA, 20 bp, Artificial Sequence
  Synthetic polynucleotide
ccttgttttgtctgctcttc

SEQ ID NO: 9273 - DNA, 20 bp, Artificial Sequence
  Synthetic polynucleotide
gaccacaggaacattaccat

SEQ ID NO: 9274 - DNA, 20 bp, Artificial Sequence
  Synthetic polynucleotide
gtcggagataatcgaaccaa

SEQ ID NO: 9275 - DNA, 20 bp, Artificial Sequence
  Synthetic polynucleotide
tctgcctgcttatcatcatc

SEQ ID NO: 9276 - DNA, 20 bp, Artificial Sequence
  Synthetic polynucleotide
atggaattgtctctgtgacc

SEQ ID NO: 9277 - DNA, 20 bp, Artificial Sequence
  Synthetic polynucleotide
ggtttcatcttcagctgttg

SEQ ID NO: 9278 - DNA, 20 bp, Artificial Sequence
  Synthetic polynucleotide
caatccgttcgaactatcct

SEQ ID NO: 9279 - DNA, 20 bp, Artificial Sequence
  Synthetic polynucleotide
aatttaaccaccatcggtca

SEQ ID NO: 9280 - DNA, 20 bp, Artificial Sequence
  Synthetic polynucleotide
aaaacgtcgacacatcctta

SEQ ID NO: 9281 - DNA, 20 bp, Artificial Sequence
  Synthetic polynucleotide
cgacgggaaaattaaagtgg

SEQ ID NO: 9282 - DNA, 20 bp, Artificial Sequence
  Synthetic polynucleotide
ccggattgaattttacgcaa

SEQ ID NO: 9283 - DNA, 20 bp, Artificial Sequence
  Synthetic polynucleotide
cgagcaaaagaaagaagtca

SEQ ID NO: 9284 - DNA, 20 bp, Artificial Sequence
  Synthetic polynucleotide
aagagcttgttgaagttgga

SEQ ID NO: 9285 - DNA, 20 bp, Artificial Sequence
  Synthetic polynucleotide
cttcgaatatgcaatgaccg

SEQ ID NO: 9286 - DNA, 20 bp, Artificial Sequence
  Synthetic polynucleotide
gtggaaaggatctggaatgt

SEQ ID NO: 9287 - DNA, 20 bp, Artificial Sequence
  Synthetic polynucleotide
tacagctgaagaaccaactc

SEQ ID NO: 9288 - DNA, 20 bp, Artificial Sequence
  Synthetic polynucleotide
aaatccacttcttcatcgct

SEQ ID NO: 9289 - DNA, 20 bp, Artificial Sequence
  Synthetic polynucleotide
cggcaaaagtaccttctaga

SEQ ID NO: 9290 - DNA, 20 bp, Artificial Sequence
  Synthetic polynucleotide
gattcttgctgttcttcgtc

SEQ ID NO: 9291 - DNA, 20 bp, Artificial Sequence
  Synthetic polynucleotide
tatcggcacctttaaagctt

SEQ ID NO: 9292 - DNA, 18 bp, Artificial Sequence
  Synthetic polynucleotide
ggacccctcatacccatc

SEQ ID NO: 9293 - DNA, 20 bp, Artificial Sequence
  Synthetic polynucleotide
acttgtttggccatatggaa

SEQ ID NO: 9294 - DNA, 20 bp, Artificial Sequence
  Synthetic polynucleotide
cctcaaaaaggtagccatct

SEQ ID NO: 9295 - DNA, 20 bp, Artificial Sequence
  Synthetic polynucleotide
ttcgtcgaaagttgaagagt

SEQ ID NO: 9296 - DNA, 20 bp, Artificial Sequence
  Synthetic polynucleotide
ctaaactgaggactgttgct

SEQ ID NO: 9297 - DNA, 20 bp, Artificial Sequence
  Synthetic polynucleotide
aagaacgtcagtcaacaaga

SEQ ID NO: 9298 - DNA, 20 bp, Artificial Sequence
  Synthetic polynucleotide
tgcctatctcgtaatcttgc

SEQ ID NO: 9299 - DNA, 20 bp, Artificial Sequence
  Synthetic polynucleotide
atagagatcaagaaaccgcc

SEQ ID NO: 9300 - DNA, 20 bp, Artificial Sequence
  Synthetic polynucleotide
aagctttctccaatggtagg

SEQ ID NO: 9301 - DNA, 20 bp, Artificial Sequence
  Synthetic polynucleotide
acaacatgagccatgaagat

SEQ ID NO: 9302 - DNA, 20 bp, Artificial Sequence
  Synthetic polynucleotide
ctgcttcggtacaaacattc

SEQ ID NO: 9303 - DNA, 20 bp, Artificial Sequence
  Synthetic polynucleotide
tcgctacgattcaagaacaa

SEQ ID NO: 9304 - DNA, 19 bp, Artificial Sequence
  Synthetic polynucleotide
agttgatgaggatgttggc

SEQ ID NO: 9305 - DNA, 20 bp, Artificial Sequence
  Synthetic polynucleotide
agctcttagattagccatgc

SEQ ID NO: 9306 - DNA, 20 bp, Artificial Sequence
  Synthetic polynucleotide
tatagcgcctatcctcatga

SEQ ID NO: 9307 - DNA, 20 bp, Artificial Sequence
  Synthetic polynucleotide
gttgtaccggtaactctctc

SEQ ID NO: 9308 - DNA, 20 bp, Artificial Sequence
  Synthetic polynucleotide
tagtccacaagcgttacaaa

SEQ ID NO: 9309 - DNA, 20 bp, Artificial Sequence
  Synthetic polynucleotide
tctcttgaaaagaacctcgg

SEQ ID NO: 9310 - DNA, 20 bp, Artificial Sequence
  Synthetic polynucleotide
ctttccggaatagcttcgta

SEQ ID NO: 9311 - DNA, 20 bp, Artificial Sequence
  Synthetic polynucleotide
ctcaaaccgtagcaacaaat

SEQ ID NO: 9312 - DNA, 20 bp, Artificial Sequence
  Synthetic polynucleotide
ataaactgtagctccccaac

SEQ ID NO: 9313 - DNA, 20 bp, Artificial Sequence
  Synthetic polynucleotide
ctggcagaaagctactctag

SEQ ID NO: 9314 - DNA, 20 bp, Artificial Sequence
  Synthetic polynucleotide
taatcatgatgcccaacaca

SEQ ID NO: 9315 - DNA, 20 bp, Artificial Sequence
  Synthetic polynucleotide
ttagttccagaaagtcaggc

SEQ ID NO: 9316 - DNA, 20 bp, Artificial Sequence
  Synthetic polynucleotide
taacaattggatctggtggg

SEQ ID NO: 9317 - DNA, 20 bp, Artificial Sequence
  Synthetic polynucleotide
aaccaactttagacgagctt

SEQ ID NO: 9318 - DNA, 20 bp, Artificial Sequence
  Synthetic polynucleotide
taggtacacgacaaatgcaa

SEQ ID NO: 9319 - DNA, 20 bp, Artificial Sequence
  Synthetic polynucleotide
aaggcccataggagagttta

SEQ ID NO: 9320 - DNA, 20 bp, Artificial Sequence
  Synthetic polynucleotide
tgttccgagtccatataggt

SEQ ID NO: 9321 - DNA, 20 bp, Artificial Sequence
  Synthetic polynucleotide
ttcgaaaccagtgaagatgt

SEQ ID NO: 9322 - DNA, 20 bp, Artificial Sequence
  Synthetic polynucleotide
tcatcacgtttgaccaagat

SEQ ID NO: 9323 - DNA, 20 bp, Artificial Sequence
  Synthetic polynucleotide
tcgaactttcaagagctcaa

SEQ ID NO: 9324 - DNA, 20 bp, Artificial Sequence
  Synthetic polynucleotide
caaaaagtggagggctagat

SEQ ID NO: 9325 - DNA, 20 bp, Artificial Sequence
  Synthetic polynucleotide
ttagtagatgttttgccccc

SEQ ID NO: 9326 - DNA, 20 bp, Artificial Sequence
  Synthetic polynucleotide
ttcttgacagatggcgttta

SEQ ID NO: 9327 - DNA, 20 bp, Artificial Sequence
  Synthetic polynucleotide
accatcgcactcttcttatc

SEQ ID NO: 9328 - DNA, 20 bp, Artificial Sequence
  Synthetic polynucleotide
ggagtgaagtcgttggtaat

SEQ ID NO: 9329 - DNA, 20 bp, Artificial Sequence
  Synthetic polynucleotide
ggacagttccatgacttgat

SEQ ID NO: 9330 - DNA, 20 bp, Artificial Sequence
  Synthetic polynucleotide
ccggatcgaactgtaagaat

SEQ ID NO: 9331 - DNA, 20 bp, Artificial Sequence
  Synthetic polynucleotide
atttggtgcttagacttcgt

SEQ ID NO: 9332 - DNA, 20 bp, Artificial Sequence
  Synthetic polynucleotide
tcgacttctagagtgatggt

SEQ ID NO: 9333 - DNA, 20 bp, Artificial Sequence
  Synthetic polynucleotide
aaatccatgaatctggtgct

SEQ ID NO: 9334 - DNA, 20 bp, Artificial Sequence
  Synthetic polynucleotide
cttgatagtctcgtccacag

SEQ ID NO: 9335 - DNA, 20 bp, Artificial Sequence
  Synthetic polynucleotide
tcttgggtttccttagaacg

SEQ ID NO: 9336 - DNA, 20 bp, Artificial Sequence
  Synthetic polynucleotide
gtagtttttccagctccaga

SEQ ID NO: 9337 - DNA, 20 bp, Artificial Sequence
  Synthetic polynucleotide
gaggctgatattgctgatga

SEQ ID NO: 9338 - DNA, 20 bp, Artificial Sequence
  Synthetic polynucleotide
ctttcggaagtgcaatcttc

SEQ ID NO: 9339 - DNA, 20 bp, Artificial Sequence
  Synthetic polynucleotide
agagacagaaaatccagcag

SEQ ID NO: 9340 - DNA, 20 bp, Artificial Sequence
  Synthetic polynucleotide
tctcctaatattgcgatggc

SEQ ID NO: 9341 - DNA, 20 bp, Artificial Sequence
  Synthetic polynucleotide
ctaatagacaacggaggtgg

SEQ ID NO: 9342 - DNA, 20 bp, Artificial Sequence
  Synthetic polynucleotide
ttctttcgccttttggaaac

SEQ ID NO: 9343 - DNA, 20 bp, Artificial Sequence
  Synthetic polynucleotide
aaggaggtgatgataatcgc

SEQ ID NO: 9344 - DNA, 20 bp, Artificial Sequence
  Synthetic polynucleotide
ctgagttggaactggaatca

SEQ ID NO: 9345 - DNA, 20 bp, Artificial Sequence
  Synthetic polynucleotide
atgggaaaaatcggtaacca

SEQ ID NO: 9346 - DNA, 20 bp, Artificial Sequence
  Synthetic polynucleotide
gccactatggatctaaccag

SEQ ID NO: 9347 - DNA, 20 bp, Artificial Sequence
  Synthetic polynucleotide
aactccttgagcttgaagag

SEQ ID NO: 9348 - DNA, 20 bp, Artificial Sequence
  Synthetic polynucleotide
ttgtcacccttctttttgga

SEQ ID NO: 9349 - DNA, 20 bp, Artificial Sequence
  Synthetic polynucleotide
ccaacgacaaattaacccct

SEQ ID NO: 9350 - DNA, 20 bp, Artificial Sequence
  Synthetic polynucleotide
gcagcagcaatgaatacatc

SEQ ID NO: 9351 - DNA, 20 bp, Artificial Sequence
  Synthetic polynucleotide
tctagagcaattaacgaggc

SEQ ID NO: 9352 - DNA, 20 bp, Artificial Sequence
  Synthetic polynucleotide
ctgatgaaattcaaggtgcc

SEQ ID NO: 9353 - DNA, 20 bp, Artificial Sequence
  Synthetic polynucleotide
attgccgaagtatttccagt

SEQ ID NO: 9354 - DNA, 20 bp, Artificial Sequence
  Synthetic polynucleotide
actcctaacgacacataacg

SEQ ID NO: 9355 - DNA, 20 bp, Artificial Sequence
  Synthetic polynucleotide
ctcgaagggagagaagaaac

SEQ ID NO: 9356 - DNA, 20 bp, Artificial Sequence
  Synthetic polynucleotide
gcaatgaaagtgaaaggcat

SEQ ID NO: 9357 - DNA, 20 bp, Artificial Sequence
  Synthetic polynucleotide
gaggcagaaaggttagttga

SEQ ID NO: 9358 - DNA, 20 bp, Artificial Sequence
  Synthetic polynucleotide
gtacaagcttctcctagagc

SEQ ID NO: 9359 - DNA, 20 bp, Artificial Sequence
  Synthetic polynucleotide
ccaccaagtagaatatgcca

SEQ ID NO: 9360 - DNA, 20 bp, Artificial Sequence
  Synthetic polynucleotide
acgttcttcaccttcaatga

SEQ ID NO: 9361 - DNA, 20 bp, Artificial Sequence
  Synthetic polynucleotide
acagtgtttagatgggtgtc

SEQ ID NO: 9362 - DNA, 20 bp, Artificial Sequence
  Synthetic polynucleotide
ttcatcgggattaacgactc

SEQ ID NO: 9363 - DNA, 20 bp, Artificial Sequence
  Synthetic polynucleotide
attatgggagctctttgtcc

SEQ ID NO: 9364 - DNA, 20 bp, Artificial Sequence
  Synthetic polynucleotide
aagaatttggtggtggaact

SEQ ID NO: 9365 - DNA, 20 bp, Artificial Sequence
  Synthetic polynucleotide
aaaaaggaggaaaggagcac

SEQ ID NO: 9366 - DNA, 20 bp, Artificial Sequence
  Synthetic polynucleotide
cgttcctctcttgacagtag

SEQ ID NO: 9367 - DNA, 20 bp, Artificial Sequence
  Synthetic polynucleotide
cgaaaacaattggccactaa

SEQ ID NO: 9368 - DNA, 20 bp, Artificial Sequence
  Synthetic polynucleotide
taattgttactcgtttggcg

SEQ ID NO: 9369 - DNA, 20 bp, Artificial Sequence
  Synthetic polynucleotide
tgttacatactgacgtgcaa

SEQ ID NO: 9370 - DNA, 20 bp, Artificial Sequence
  Synthetic polynucleotide
gaatcaccaaaagagcttcg

SEQ ID NO: 9371 - DNA, 20 bp, Artificial Sequence
  Synthetic polynucleotide
ggtgtcaaatcagtgactct

SEQ ID NO: 9372 - DNA, 20 bp, Artificial Sequence
  Synthetic polynucleotide
gcatcatcattgttccaagg

SEQ ID NO: 9373 - DNA, 20 bp, Artificial Sequence
  Synthetic polynucleotide
aaaccgccgtattcgtatta

SEQ ID NO: 9374 - DNA, 20 bp, Artificial Sequence
  Synthetic polynucleotide
cgaaaagattggttgctacc

SEQ ID NO: 9375 - DNA, 20 bp, Artificial Sequence
  Synthetic polynucleotide
ggattggaagctggagatag

SEQ ID NO: 9376 - DNA, 20 bp, Artificial Sequence
  Synthetic polynucleotide
aacctattgcagcattctga

SEQ ID NO: 9377 - DNA, 20 bp, Artificial Sequence
  Synthetic polynucleotide
gcctggtacaaaagtagaca

SEQ ID NO: 9378 - DNA, 20 bp, Artificial Sequence
  Synthetic polynucleotide
tgcgctttcacttttgaatt

SEQ ID NO: 9379 - DNA, 20 bp, Artificial Sequence
  Synthetic polynucleotide
cacgaaactaggaaccagaa

SEQ ID NO: 9380 - DNA, 20 bp, Artificial Sequence
  Synthetic polynucleotide
ccttcgaggacataaccatc

SEQ ID NO: 9381 - DNA, 20 bp, Artificial Sequence
  Synthetic polynucleotide
accaatggaagtaatgggac

SEQ ID NO: 9382 - DNA, 20 bp, Artificial Sequence
  Synthetic polynucleotide
gttgctctggtgtcattttt

SEQ ID NO: 9383 - DNA, 20 bp, Artificial Sequence
  Synthetic polynucleotide
agaacagggaagctatgttg

SEQ ID NO: 9384 - DNA, 20 bp, Artificial Sequence
  Synthetic polynucleotide
ggttgcttcaaaaccatcaa

SEQ ID NO: 9385 - DNA, 20 bp, Artificial Sequence
  Synthetic polynucleotide
gctggaaattttggtgaagt

SEQ ID NO: 9386 - DNA, 20 bp, Artificial Sequence
  Synthetic polynucleotide
cagttacgacgacaccaata

SEQ ID NO: 9387 - DNA, 20 bp, Artificial Sequence
  Synthetic polynucleotide
gtcgaatatgccattgaagc

SEQ ID NO: 9388 - DNA, 20 bp, Artificial Sequence
  Synthetic polynucleotide
tcatgacttctacattcgca

SEQ ID NO: 9389 - DNA, 20 bp, Artificial Sequence
  Synthetic polynucleotide
actcgaagatcagagagaca

SEQ ID NO: 9390 - DNA, 20 bp, Artificial Sequence
  Synthetic polynucleotide
tcgtaaacgtttcagtgtct

SEQ ID NO: 9391 - DNA, 20 bp, Artificial Sequence
  Synthetic polynucleotide
tgcccaagaagatccttaac

SEQ ID NO: 9392 - DNA, 20 bp, Artificial Sequence
  Synthetic polynucleotide
aatgtgcatggtcctttttg

SEQ ID NO: 9393 - DNA, 20 bp, Artificial Sequence
  Synthetic polynucleotide
ttccaggcactcaaagaatt

SEQ ID NO: 9394 - DNA, 20 bp, Artificial Sequence
  Synthetic polynucleotide
ttttcacgccatcatcctta

SEQ ID NO: 9395 - DNA, 20 bp, Artificial Sequence
  Synthetic polynucleotide
ttgggaaatgtcaaacatgc

SEQ ID NO: 9396 - DNA, 20 bp, Artificial Sequence
  Synthetic polynucleotide
gggaagtctgaggcataaaa

SEQ ID NO: 9397 - DNA, 20 bp, Artificial Sequence
  Synthetic polynucleotide
gacgcagatcactcagtatt

SEQ ID NO: 9398 - DNA, 20 bp, Artificial Sequence
  Synthetic polynucleotide
gacgtttcggcaatatttgt

SEQ ID NO: 9399 - DNA, 20 bp, Artificial Sequence
  Synthetic polynucleotide
tagctggtcaagaaagtcac

SEQ ID NO: 9400 - DNA, 20 bp, Artificial Sequence
  Synthetic polynucleotide
aggaattcaagaccagtcac

SEQ ID NO: 9401 - DNA, 20 bp, Artificial Sequence
  Synthetic polynucleotide
aagtacaaaaaggagggcaa

SEQ ID NO: 9402 - DNA, 20 bp, Artificial Sequence
  Synthetic polynucleotide
catcgtcttctagttcgtgt

SEQ ID NO: 9403 - DNA, 20 bp, Artificial Sequence
  Synthetic polynucleotide
aaaactcctagacgaaaccc

SEQ ID NO: 9404 - DNA, 20 bp, Artificial Sequence
  Synthetic polynucleotide
tgctgtttcttccctaagtc

SEQ ID NO: 9405 - DNA, 20 bp, Artificial Sequence
  Synthetic polynucleotide
gaagatgatcaaatcgacgc

SEQ ID NO: 9406 - DNA, 20 bp, Artificial Sequence
  Synthetic polynucleotide
tccctggatttttcatctgg

SEQ ID NO: 9407 - DNA, 20 bp, Artificial Sequence
  Synthetic polynucleotide
tgtgaagatctcctttcgtc

SEQ ID NO: 9408 - DNA, 20 bp, Artificial Sequence
  Synthetic polynucleotide
ctttctgtcagaggttggac

SEQ ID NO: 9409 - DNA, 20 bp, Artificial Sequence
  Synthetic polynucleotide
caatggacctgggaacaata

SEQ ID NO: 9410 - DNA, 20 bp, Artificial Sequence
  Synthetic polynucleotide
gtgggctttttaatttgcct

SEQ ID NO: 9411 - DNA, 20 bp, Artificial Sequence
  Synthetic polynucleotide
caatttcgttcatcagcagg

SEQ ID NO: 9412 - DNA, 20 bp, Artificial Sequence
  Synthetic polynucleotide
ctagacaaatcggtgttgga

SEQ ID NO: 9413 - DNA, 20 bp, Artificial Sequence
  Synthetic polynucleotide
ttgtcaccagaacaatttgc

SEQ ID NO: 9414 - DNA, 20 bp, Artificial Sequence
  Synthetic polynucleotide
ccaatcatcctcgtcatcat

SEQ ID NO: 9415 - DNA, 20 bp, Artificial Sequence
  Synthetic polynucleotide
ttttgggaagcgatagtgaa

SEQ ID NO: 9416 - DNA, 20 bp, Artificial Sequence
  Synthetic polynucleotide
ctcccaaaccaatggatgta

SEQ ID NO: 9417 - DNA, 20 bp, Artificial Sequence
  Synthetic polynucleotide
ccaaagcgttaccaaaaact

SEQ ID NO: 9418 - DNA, 20 bp, Artificial Sequence
  Synthetic polynucleotide
tgagcgtttgtcacttcata

SEQ ID NO: 9419 - DNA, 20 bp, Artificial Sequence
  Synthetic polynucleotide
actctcaatgtgttgatgct

SEQ ID NO: 9420 - DNA, 20 bp, Artificial Sequence
  Synthetic polynucleotide
acaggaggatttttggatcc

SEQ ID NO: 9421 - DNA, 20 bp, Artificial Sequence
  Synthetic polynucleotide
tcgctttagaaaccatcgat

SEQ ID NO: 9422 - DNA, 20 bp, Artificial Sequence
  Synthetic polynucleotide
tggattaaacataggaggcc

SEQ ID NO: 9423 - DNA, 20 bp, Artificial Sequence
  Synthetic polynucleotide
acctgtgaaactattaccgg

SEQ ID NO: 9424 - DNA, 20 bp, Artificial Sequence
  Synthetic polynucleotide
agctcgaagaattgctgatt

SEQ ID NO: 9425 - DNA, 20 bp, Artificial Sequence
  Synthetic polynucleotide
aagaaactgacaacttgggt

SEQ ID NO: 9426 - DNA, 20 bp, Artificial Sequence
  Synthetic polynucleotide
cctatggctctttgtaggac

SEQ ID NO: 9427 - DNA, 21 bp, Artificial Sequence
  Synthetic polynucleotide
gacgaaaatgatcgaatgact

SEQ ID NO: 9428 - DNA, 21 bp, Artificial Sequence
  Synthetic polynucleotide
tgatataatgctgaccacctt

SEQ ID NO: 9429 - DNA, 20 bp, Artificial Sequence
  Synthetic polynucleotide
caattgataaaggtccccca

SEQ ID NO: 9430 - DNA, 20 bp, Artificial Sequence
  Synthetic polynucleotide
taggcatagtcaagatggga

SEQ ID NO: 9431 - DNA, 20 bp, Artificial Sequence
  Synthetic polynucleotide
gaacttttatctccggacga

SEQ ID NO: 9432 - DNA, 20 bp, Artificial Sequence
  Synthetic polynucleotide
tttatctccacctctttgcc

SEQ ID NO: 9433 - DNA, 20 bp, Artificial Sequence
  Synthetic polynucleotide
atctgttgttgcatcaggat

SEQ ID NO: 9434 - DNA, 20 bp, Artificial Sequence
  Synthetic polynucleotide
tatcccatagttgagcctga

SEQ ID NO: 9435 - DNA, 20 bp, Artificial Sequence
  Synthetic polynucleotide
taaacataaaaagcgccgac

SEQ ID NO: 9436 - DNA, 20 bp, Artificial Sequence
  Synthetic polynucleotide
cttgttctatgtcttgctgc

SEQ ID NO: 9437 - DNA, 20 bp, Artificial Sequence
  Synthetic polynucleotide
gtaccggcaaaactactttc

SEQ ID NO: 9438 - DNA, 20 bp, Artificial Sequence
  Synthetic polynucleotide
atttgttgttgccattgagg

SEQ ID NO: 9439 - DNA, 20 bp, Artificial Sequence
  Synthetic polynucleotide
cagttgacgatcctaggaag

SEQ ID NO: 9440 - DNA, 20 bp, Artificial Sequence
  Synthetic polynucleotide
tggagaatcctgtcagtttg

SEQ ID NO: 9441 - DNA, 21 bp, Artificial Sequence
  Synthetic polynucleotide
ccagaagatatgcaacaacag

SEQ ID NO: 9442 - DNA, 19 bp, Artificial Sequence
  Synthetic polynucleotide
ttttacagctgaaaccgct

SEQ ID NO: 9443 - DNA, 20 bp, Artificial Sequence
  Synthetic polynucleotide
aaggaagattaaagcctggg

SEQ ID NO: 9444 - DNA, 20 bp, Artificial Sequence
  Synthetic polynucleotide
cctgcgctttctctagtatt

SEQ ID NO: 9445 - DNA, 20 bp, Artificial Sequence
  Synthetic polynucleotide
gacgcagatcactcagtatt

SEQ ID NO: 9446 - DNA, 20 bp, Artificial Sequence
  Synthetic polynucleotide
gacgtttcggcaatatttgt

SEQ ID NO: 9447 - DNA, 20 bp, Artificial Sequence
  Synthetic polynucleotide
cgacccttctctacgaaaat

SEQ ID NO: 9448 - DNA, 20 bp, Artificial Sequence
  Synthetic polynucleotide
ttcttccatcatcaccttgg

SEQ ID NO: 9449 - DNA, 20 bp, Artificial Sequence
  Synthetic polynucleotide
tgtgcaatcaaagttgaacc

SEQ ID NO: 9450 - DNA, 20 bp, Artificial Sequence
  Synthetic polynucleotide
cagactttcttggttcggta

SEQ ID NO: 9451 - DNA, 20 bp, Artificial Sequence
  Synthetic polynucleotide
ttcatctttggcccctaaaa

SEQ ID NO: 9452 - DNA, 20 bp, Artificial Sequence
  Synthetic polynucleotide
gatggtgcaacctacagatt

SEQ ID NO: 9453 - DNA, 20 bp, Artificial Sequence
  Synthetic polynucleotide
gcaaaagagcactgattctc

SEQ ID NO: 9454 - DNA, 20 bp, Artificial Sequence
  Synthetic polynucleotide
tccatccaaaaccctttcaa

SEQ ID NO: 9455 - DNA, 20 bp, Artificial Sequence
  Synthetic polynucleotide
gcccagtacaataaagacca

SEQ ID NO: 9456 - DNA, 20 bp, Artificial Sequence
  Synthetic polynucleotide
atcgatttttgtcctggtga

SEQ ID NO: 9457 - DNA, 20 bp, Artificial Sequence
  Synthetic polynucleotide
gagtttatggtgacccacat

SEQ ID NO: 9458 - DNA, 20 bp, Artificial Sequence
  Synthetic polynucleotide
ggtataatgtcttccggcat

SEQ ID NO: 9459 - DNA, 20 bp, Artificial Sequence
  Synthetic polynucleotide
tggttcagtaggagttgaag

SEQ ID NO: 9460 - DNA, 18 bp, Artificial Sequence
  Synthetic polynucleotide
ctttcttctgctctgcgg

SEQ ID NO: 9461 - DNA, 20 bp, Artificial Sequence
  Synthetic polynucleotide
attgtagctgaatgcaatgc

SEQ ID NO: 9462 - DNA, 20 bp, Artificial Sequence
  Synthetic polynucleotide
cttgtactgcaacctgtact

SEQ ID NO: 9463 - DNA, 20 bp, Artificial Sequence
  Synthetic polynucleotide
tgcttctctcttcggtagta

SEQ ID NO: 9464 - DNA, 20 bp, Artificial Sequence
  Synthetic polynucleotide
atttgttcgagatgtgagct

SEQ ID NO: 9465 - DNA, 18 bp, Artificial Sequence
  Synthetic polynucleotide
ttcctcggtctcgacaat

SEQ ID NO: 9466 - DNA, 20 bp, Artificial Sequence
  Synthetic polynucleotide
actaccgagcacatgaatac

SEQ ID NO: 9467 - DNA, 21 bp, Artificial Sequence
  Synthetic polynucleotide
agtttttccattaggagacca

SEQ ID NO: 9468 - DNA, 25 bp, Artificial Sequence
  Synthetic polynucleotide
tcattataattttgtagagctacca

SEQ ID NO: 9469 - DNA, 20 bp, Artificial Sequence
  Synthetic polynucleotide
ggagactggttaaagctgaa

SEQ ID NO: 9470 - DNA, 20 bp, Artificial Sequence
  Synthetic polynucleotide
ataacgaatggaaggagacg

SEQ ID NO: 9471 - DNA, 20 bp, Artificial Sequence
  Synthetic polynucleotide
cagaccagatttcaacctca

SEQ ID NO: 9472 - DNA, 20 bp, Artificial Sequence
  Synthetic polynucleotide
ctggtggttcaagttgtttc

SEQ ID NO: 9473 - DNA, 20 bp, Artificial Sequence
  Synthetic polynucleotide
gttgaagaccctgaaagcta

SEQ ID NO: 9474 - DNA, 20 bp, Artificial Sequence
  Synthetic polynucleotide
ctcagccatgtattgcaaag

SEQ ID NO: 9475 - DNA, 20 bp, Artificial Sequence
  Synthetic polynucleotide
gaagcccgtttgatactttg

SEQ ID NO: 9476 - DNA, 20 bp, Artificial Sequence
  Synthetic polynucleotide
ctactaactcgagtttcgca

SEQ ID NO: 9477 - DNA, 20 bp, Artificial Sequence
  Synthetic polynucleotide
tccgaaagaaacgaattcct

SEQ ID NO: 9478 - DNA, 20 bp, Artificial Sequence
  Synthetic polynucleotide
aaatatttgaacacgccgtc

SEQ ID NO: 9479 - DNA, 20 bp, Artificial Sequence
  Synthetic polynucleotide
gaaaaattacgcgattgggt

SEQ ID NO: 9480 - DNA, 20 bp, Artificial Sequence
  Synthetic polynucleotide
ttccttcgtcgtaaaacagt

SEQ ID NO: 9481 - DNA, 20 bp, Artificial Sequence
  Synthetic polynucleotide
gcgactattcagaggatctc

SEQ ID NO: 9482 - DNA, 20 bp, Artificial Sequence
  Synthetic polynucleotide
tttgatcgctagactcttcg

SEQ ID NO: 9483 - DNA, 20 bp, Artificial Sequence
  Synthetic polynucleotide
cggacgtgattttaatgtgt

SEQ ID NO: 9484 - DNA, 20 bp, Artificial Sequence
  Synthetic polynucleotide
gttcgttaatggtagtggga

SEQ ID NO: 9485 - DNA, 20 bp, Artificial Sequence
  Synthetic polynucleotide
gcatgtgtcccactatagag

SEQ ID NO: 9486 - DNA, 20 bp, Artificial Sequence
  Synthetic polynucleotide
tggtcgttatagttttgcca

SEQ ID NO: 9487 - DNA, 20 bp, Artificial Sequence
  Synthetic polynucleotide
ggttgtcaattccacgtttt

SEQ ID NO: 9488 - DNA, 20 bp, Artificial Sequence
  Synthetic polynucleotide
tctaatccgtcaagaggtct

SEQ ID NO: 9489 - DNA, 20 bp, Artificial Sequence
  Synthetic polynucleotide
tgctgttgttgaatttggtc

SEQ ID NO: 9490 - DNA, 20 bp, Artificial Sequence
  Synthetic polynucleotide
caagccagttgcaactaaaa

SEQ ID NO: 9491 - DNA, 20 bp, Artificial Sequence
  Synthetic polynucleotide
catcaaccagaagaagacca

SEQ ID NO: 9492 - DNA, 20 bp, Artificial Sequence
  Synthetic polynucleotide
ttccgaccatgttctgtatc

SEQ ID NO: 9493 - DNA, 20 bp, Artificial Sequence
  Synthetic polynucleotide
actgcaagaagaggatatgc

SEQ ID NO: 9494 - DNA, 20 bp, Artificial Sequence
  Synthetic polynucleotide
tgagctttagtgcggatatc

SEQ ID NO: 9495 - DNA, 20 bp, Artificial Sequence
  Synthetic polynucleotide
tacgaaaaattgagcaggga

SEQ ID NO: 9496 - DNA, 20 bp, Artificial Sequence
  Synthetic polynucleotide
cttgtttcttctgttcgtcg

SEQ ID NO: 9497 - DNA, 20 bp, Artificial Sequence
  Synthetic polynucleotide
taagaagcacagtgatcgag

SEQ ID NO: 9498 - DNA, 20 bp, Artificial Sequence
  Synthetic polynucleotide
ggtctccacttcccttattc

SEQ ID NO: 9499 - DNA, 20 bp, Artificial Sequence
  Synthetic polynucleotide
acttacacgatccacgaaaa

SEQ ID NO: 9500 - DNA, 20 bp, Artificial Sequence
  Synthetic polynucleotide
caattctggcatgtccaatc

SEQ ID NO: 9501 - DNA, 20 bp, Artificial Sequence
  Synthetic polynucleotide
tcatcgctacaaacatttgc

SEQ ID NO: 9502 - DNA, 20 bp, Artificial Sequence
  Synthetic polynucleotide
ctccaatacacaatccacca

SEQ ID NO: 9503 - DNA, 20 bp, Artificial Sequence
  Synthetic polynucleotide
agccgaacaagacaaactat

SEQ ID NO: 9504 - DNA, 20 bp, Artificial Sequence
  Synthetic polynucleotide
atatcctcctcgaccagaat

SEQ ID NO: 9505 - DNA, 20 bp, Artificial Sequence
  Synthetic polynucleotide
tgacgacaattagccagaaa

SEQ ID NO: 9506 - DNA, 20 bp, Artificial Sequence
  Synthetic polynucleotide
gcgataaggaaggtgaagat

SEQ ID NO: 9507 - DNA, 20 bp, Artificial Sequence
  Synthetic polynucleotide
gaatggattgccgcattaaa

SEQ ID NO: 9508 - DNA, 20 bp, Artificial Sequence
  Synthetic polynucleotide
attgtcatgagccttccatt

SEQ ID NO: 9509 - DNA, 21 bp, Artificial Sequence
  Synthetic polynucleotide
tcccttattcgaaaagagacc

SEQ ID NO: 9510 - DNA, 20 bp, Artificial Sequence
  Synthetic polynucleotide
gatttggaaccgaggatacc

SEQ ID NO: 9511 - DNA, 20 bp, Artificial Sequence
  Synthetic polynucleotide
gtttctggtatgtactgggg

SEQ ID NO: 9512 - DNA, 20 bp, Artificial Sequence
  Synthetic polynucleotide
tcaaagcattgccatcaatc

SEQ ID NO: 9513 - DNA, 20 bp, Artificial Sequence
  Synthetic polynucleotide
tatggaggttgtgtgtgaag

SEQ ID NO: 9514 - DNA, 20 bp, Artificial Sequence
  Synthetic polynucleotide
accggttattagactctcca

SEQ ID NO: 9515 - DNA, 20 bp, Artificial Sequence
  Synthetic polynucleotide
ttacaggagacacccaaatg

SEQ ID NO: 9516 - DNA, 20 bp, Artificial Sequence
  Synthetic polynucleotide
cccaattctctgtgtcttga

SEQ ID NO: 9517 - DNA, 20 bp, Artificial Sequence
  Synthetic polynucleotide
ctctaggacgtttattggca

SEQ ID NO: 9518 - DNA, 20 bp, Artificial Sequence
  Synthetic polynucleotide
gaggtcctctcatacccatt

SEQ ID NO: 9519 - DNA, 20 bp, Artificial Sequence
  Synthetic polynucleotide
gtacatagcgactggatgtt

SEQ ID NO: 9520 - DNA, 20 bp, Artificial Sequence
  Synthetic polynucleotide
cgttaagaggacgatggaat

SEQ ID NO: 9521 - DNA, 20 bp, Artificial Sequence
  Synthetic polynucleotide
gaagcccgtttgatactttg

SEQ ID NO: 9522 - DNA, 20 bp, Artificial Sequence
  Synthetic polynucleotide
ctactaactcgagtttcgca

SEQ ID NO: 9523 - DNA, 20 bp, Artificial Sequence
  Synthetic polynucleotide
cagatcaaggaacagacaca

SEQ ID NO: 9524 - DNA, 20 bp, Artificial Sequence
  Synthetic polynucleotide
ttatgtatttggcgaggagg

SEQ ID NO: 9525 - DNA, 20 bp, Artificial Sequence
  Synthetic polynucleotide
cctccagaacagatgtttga

SEQ ID NO: 9526 - DNA, 20 bp, Artificial Sequence
  Synthetic polynucleotide
aattggaggacttgcatgat

SEQ ID NO: 9527 - DNA, 20 bp, Artificial Sequence
  Synthetic polynucleotide
taaattaaaggcagggaccc

SEQ ID NO: 9528 - DNA, 20 bp, Artificial Sequence
  Synthetic polynucleotide
aatctagcctgttcattggg

SEQ ID NO: 9529 - DNA, 20 bp, Artificial Sequence
  Synthetic polynucleotide
aatgagctccgtttgatagg

SEQ ID NO: 9530 - DNA, 20 bp, Artificial Sequence
  Synthetic polynucleotide
tcgcttataagagcctcaac

SEQ ID NO: 9531 - DNA, 20 bp, Artificial Sequence
  Synthetic polynucleotide
gaaattgctagtgaatgggc

SEQ ID NO: 9532 - DNA, 20 bp, Artificial Sequence
  Synthetic polynucleotide
cgtgctctttgttcttgtac

SEQ ID NO: 9533 - DNA, 20 bp, Artificial Sequence
  Synthetic polynucleotide
ttggttggcaattctgaaac

SEQ ID NO: 9534 - DNA, 20 bp, Artificial Sequence
  Synthetic polynucleotide
tggagatgtgtagtgttgtg

SEQ ID NO: 9535 - DNA, 20 bp, Artificial Sequence
  Synthetic polynucleotide
cgtttgtcgaagctagtcta

SEQ ID NO: 9536 - DNA, 20 bp, Artificial Sequence
  Synthetic polynucleotide
tgttgatcttctcccaagtg

SEQ ID NO: 9537 - DNA, 20 bp, Artificial Sequence
  Synthetic polynucleotide
atgctctatgagaagcgttt

SEQ ID NO: 9538 - DNA, 20 bp, Artificial Sequence
  Synthetic polynucleotide
cccaaccagaaatagcatct

SEQ ID NO: 9539 - DNA, 20 bp, Artificial Sequence
  Synthetic polynucleotide
atcaccaagttctcttccac

SEQ ID NO: 9540 - DNA, 20 bp, Artificial Sequence
  Synthetic polynucleotide
agccgttattaatcgttcga

SEQ ID NO: 9541 - DNA, 20 bp, Artificial Sequence
  Synthetic polynucleotide
tcttgttgctcgactatcag

SEQ ID NO: 9542 - DNA, 20 bp, Artificial Sequence
  Synthetic polynucleotide
gcaccttggtgtagaagtaa

SEQ ID NO: 9543 - DNA, 21 bp, Artificial Sequence
  Synthetic polynucleotide
agagggttgggagttaataga

SEQ ID NO: 9544 - DNA, 20 bp, Artificial Sequence
  Synthetic polynucleotide
ggaaccctacagatgcaatt

SEQ ID NO: 9545 - DNA, 20 bp, Artificial Sequence
  Synthetic polynucleotide
taacgaattgcagcgagata

SEQ ID NO: 9546 - DNA, 20 bp, Artificial Sequence
  Synthetic polynucleotide
gcctattctttcaaggtcca

SEQ ID NO: 9547 - DNA, 20 bp, Artificial Sequence
  Synthetic polynucleotide
tttccatttccatcctccag

SEQ ID NO: 9548 - DNA, 20 bp, Artificial Sequence
  Synthetic polynucleotide
actgcctcataataacgtcc

SEQ ID NO: 9549 - DNA, 20 bp, Artificial Sequence
  Synthetic polynucleotide
aatattaatgccgccaaagc

SEQ ID NO: 9550 - DNA, 20 bp, Artificial Sequence
  Synthetic polynucleotide
gatcacctttatgtcggaca

SEQ ID NO: 9551 - DNA, 20 bp, Artificial Sequence
  Synthetic polynucleotide
aaaaccatcagcaagtgttg

SEQ ID NO: 9552 - DNA, 20 bp, Artificial Sequence
  Synthetic polynucleotide
agattctgtcaggtctagct

SEQ ID NO: 9553 - DNA, 23 bp, Artificial Sequence
  Synthetic polynucleotide
cgttatttatcgtgtgtttttcg

SEQ ID NO: 9554 - DNA, 20 bp, Artificial Sequence
  Synthetic polynucleotide
tgttgaaagttttgcggatt

SEQ ID NO: 9555 - DNA, 20 bp, Artificial Sequence
  Synthetic polynucleotide
tggattgagcagttaaacga

SEQ ID NO: 9556 - DNA, 19 bp, Artificial Sequence
  Synthetic polynucleotide
gttgaacgtctcggagatg

SEQ ID NO: 9557 - DNA, 20 bp, Artificial Sequence
  Synthetic polynucleotide
aaactttgaccggaaaaacc

SEQ ID NO: 9558 - DNA, 20 bp, Artificial Sequence
  Synthetic polynucleotide
attctcaatggtatcggagg

SEQ ID NO: 9559 - DNA, 20 bp, Artificial Sequence
  Synthetic polynucleotide
gataacgttcgggaatacca

SEQ ID NO: 9560 - DNA, 20 bp, Artificial Sequence
  Synthetic polynucleotide
cgcgttgatcttgataatgg

SEQ ID NO: 9561 - DNA, 20 bp, Artificial Sequence
  Synthetic polynucleotide
gcattacccgatatggaagt

SEQ ID NO: 9562 - DNA, 20 bp, Artificial Sequence
  Synthetic polynucleotide
gttttcattggtccatcgac

SEQ ID NO: 9563 - DNA, 20 bp, Artificial Sequence
  Synthetic polynucleotide
gccatacgttttgaagactg

SEQ ID NO: 9564 - DNA, 20 bp, Artificial Sequence
  Synthetic polynucleotide
gtggttttgttttgcaaacc

SEQ ID NO: 9565 - DNA, 20 bp, Artificial Sequence
  Synthetic polynucleotide
ctccgaaatcaaaaagaccg

SEQ ID NO: 9566 - DNA, 20 bp, Artificial Sequence
  Synthetic polynucleotide
tagcgaaaatcactatgggg

SEQ ID NO: 9567 - DNA, 20 bp, Artificial Sequence
  Synthetic polynucleotide
ggaattttgaaggggctaga

SEQ ID NO: 9568 - DNA, 20 bp, Artificial Sequence
  Synthetic polynucleotide
ggcagtttacttggactgta

SEQ ID NO: 9569 - DNA, 20 bp, Artificial Sequence
  Synthetic polynucleotide
atacagagcagaatggcaaa

SEQ ID NO: 9570 - DNA, 20 bp, Artificial Sequence
  Synthetic polynucleotide
gccaacaatttcagactagc

SEQ ID NO: 9571 - DNA, 20 bp, Artificial Sequence
  Synthetic polynucleotide
acaacaactaaagtggtggt

SEQ ID NO: 9572 - DNA, 20 bp, Artificial Sequence
  Synthetic polynucleotide
caaccaacatctgatcgttg

SEQ ID NO: 9573 - DNA, 20 bp, Artificial Sequence
  Synthetic polynucleotide
gtggaagaaaagttcagctg

SEQ ID NO: 9574 - DNA, 20 bp, Artificial Sequence
  Synthetic polynucleotide
cttatcgttcctgtccacag

SEQ ID NO: 9575 - DNA, 18 bp, Artificial Sequence
  Synthetic polynucleotide
tcatttcagcccatacgc

SEQ ID NO: 9576 - DNA, 20 bp, Artificial Sequence
  Synthetic polynucleotide
ccagtgtaaatgtccctctc

SEQ ID NO: 9577 - DNA, 20 bp, Artificial Sequence
  Synthetic polynucleotide
agctttagaacagctgacaa

SEQ ID NO: 9578 - DNA, 20 bp, Artificial Sequence
  Synthetic polynucleotide
ggccggtttaaaattccttc

SEQ ID NO: 9579 - DNA, 20 bp, Artificial Sequence
  Synthetic polynucleotide
ttgaagaacgtcaaaatggc

SEQ ID NO: 9580 - DNA, 19 bp, Artificial Sequence
  Synthetic polynucleotide
gtaaacaaccctcggttcc

SEQ ID NO: 9581 - DNA, 20 bp, Artificial Sequence
  Synthetic polynucleotide
aagtcaaaaagtggaatgcc

SEQ ID NO: 9582 - DNA, 20 bp, Artificial Sequence
  Synthetic polynucleotide
gccgagtctttaaccatctt

SEQ ID NO: 9583 - DNA, 20 bp, Artificial Sequence
  Synthetic polynucleotide
ggctaaaatcgccgaattag

SEQ ID NO: 9584 - DNA, 19 bp, Artificial Sequence
  Synthetic polynucleotide
gtaagcctccatagctacg

SEQ ID NO: 9585 - DNA, 19 bp, Artificial Sequence
  Synthetic polynucleotide
cctccaccaagtcgaatac

SEQ ID NO: 9586 - DNA, 20 bp, Artificial Sequence
  Synthetic polynucleotide
tccttcaatcaaagccaaga

SEQ ID NO: 9587 - DNA, 20 bp, Artificial Sequence
  Synthetic polynucleotide
ggaatggcataaaagagtgc

SEQ ID NO: 9588 - DNA, 20 bp, Artificial Sequence
  Synthetic polynucleotide
cgctctctccaacttactac

SEQ ID NO: 9589 - DNA, 20 bp, Artificial Sequence
  Synthetic polynucleotide
tgggggtttagatgacaaag

SEQ ID NO: 9590 - DNA, 20 bp, Artificial Sequence
  Synthetic polynucleotide
aggttgcatatttgtagggg

SEQ ID NO: 9591 - DNA, 20 bp, Artificial Sequence
  Synthetic polynucleotide
ctacttggatttcagcgaac

SEQ ID NO: 9592 - DNA, 20 bp, Artificial Sequence
  Synthetic polynucleotide
gatgagaccgactttacgac

SEQ ID NO: 9593 - DNA, 20 bp, Artificial Sequence
  Synthetic polynucleotide
gtaaacagttggcaaccaaa

SEQ ID NO: 9594 - DNA, 20 bp, Artificial Sequence
  Synthetic polynucleotide
tatcttcgaaaagaccgacc

SEQ ID NO: 9595 - DNA, 20 bp, Artificial Sequence
  Synthetic polynucleotide
cagagcttcttcttgagctc

SEQ ID NO: 9596 - DNA, 18 bp, Artificial Sequence
  Synthetic polynucleotide
caaatccagcaccctacc

SEQ ID NO: 9597 - DNA, 20 bp, Artificial Sequence
  Synthetic polynucleotide
aagtatttcgtagtcggagc

SEQ ID NO: 9598 - DNA, 20 bp, Artificial Sequence
  Synthetic polynucleotide
gttggcggaaagttaaacaa

SEQ ID NO: 9599 - DNA, 20 bp, Artificial Sequence
  Synthetic polynucleotide
tattgtcgattgcggttttg

SEQ ID NO: 9600 - DNA, 20 bp, Artificial Sequence
  Synthetic polynucleotide
ggtccattcctctgtgaatt

SEQ ID NO: 9601 - DNA, 19 bp, Artificial Sequence
  Synthetic polynucleotide
cgagcaagcaagacaaatc

SEQ ID NO: 9602 - DNA, 20 bp, Artificial Sequence
  Synthetic polynucleotide
tacagaaatcttgcccactc

SEQ ID NO: 9603 - DNA, 20 bp, Artificial Sequence
  Synthetic polynucleotide
agtggatatgacccatcaga

SEQ ID NO: 9604 - DNA, 20 bp, Artificial Sequence
  Synthetic polynucleotide
cacctttccaaaatgaaccc

SEQ ID NO: 9605 - DNA, 20 bp, Artificial Sequence
  Synthetic polynucleotide
agataccggaaatttcgcat

SEQ ID NO: 9606 - DNA, 20 bp, Artificial Sequence
  Synthetic polynucleotide
aacatatccatcagcccttc

SEQ ID NO: 9607 - DNA, 19 bp, Artificial Sequence
  Synthetic polynucleotide
tgaggctctctctgaaagg

SEQ ID NO: 9608 - DNA, 20 bp, Artificial Sequence
  Synthetic polynucleotide
tgcctgtttagtccatgaat

SEQ ID NO: 9609 - DNA, 20 bp, Artificial Sequence
  Synthetic polynucleotide
ccacttatgaaatggtggga

SEQ ID NO: 9610 - DNA, 20 bp, Artificial Sequence
  Synthetic polynucleotide
agcatacatacctgcttcag

SEQ ID NO: 9611 - DNA, 18 bp, Artificial Sequence
  Synthetic polynucleotide
tggttgaaatcggccttc

SEQ ID NO: 9612 - DNA, 20 bp, Artificial Sequence
  Synthetic polynucleotide
taaatcgtccagtttttcgc

SEQ ID NO: 9613 - DNA, 21 bp, Artificial Sequence
  Synthetic polynucleotide
gatagggcaagaatagaatgc

SEQ ID NO: 9614 - DNA, 20 bp, Artificial Sequence
  Synthetic polynucleotide
cgatggtaaacctcctgaag

SEQ ID NO: 9615 - DNA, 20 bp, Artificial Sequence
  Synthetic polynucleotide
acgcatttgttgaacaagtt

SEQ ID NO: 9616 - DNA, 20 bp, Artificial Sequence
  Synthetic polynucleotide
aaacactctcaaggctttca

SEQ ID NO: 9617 - DNA, 19 bp, Artificial Sequence
  Synthetic polynucleotide
catctcgtcgcagtagaag

SEQ ID NO: 9618 - DNA, 19 bp, Artificial Sequence
  Synthetic polynucleotide
gatctgttctcgaccatgg

SEQ ID NO: 9619 - DNA, 20 bp, Artificial Sequence
  Synthetic polynucleotide
ccgggggctttctataattt

SEQ ID NO: 9620 - DNA, 20 bp, Artificial Sequence
  Synthetic polynucleotide
cgaaccttcattttggtcaa

SEQ ID NO: 9621 - DNA, 20 bp, Artificial Sequence
  Synthetic polynucleotide
gaaaatacaggcgttgtcag

SEQ ID NO: 9622 - DNA, 20 bp, Artificial Sequence
  Synthetic polynucleotide
caggcaaatccaaaaaccat

SEQ ID NO: 9623 - DNA, 20 bp, Artificial Sequence
  Synthetic polynucleotide
gtcaagagagcaccatagag

SEQ ID NO: 9624 - DNA, 20 bp, Artificial Sequence
  Synthetic polynucleotide
taaaagtccggtttcatcgt

SEQ ID NO: 9625 - DNA, 20 bp, Artificial Sequence
  Synthetic polynucleotide
gaggaggttcttcgaaaact

SEQ ID NO: 9626 - DNA, 20 bp, Artificial Sequence
  Synthetic polynucleotide
tgtacagagcagaccttttc

SEQ ID NO: 9627 - DNA, 20 bp, Artificial Sequence
  Synthetic polynucleotide
caccacgataaacttctgga

SEQ ID NO: 9628 - DNA, 20 bp, Artificial Sequence
  Synthetic polynucleotide
cagcatgtatttcaaggctg

SEQ ID NO: 9629 - DNA, 20 bp, Artificial Sequence
  Synthetic polynucleotide
gaaaaacacgacttgcagaa

SEQ ID NO: 9630 - DNA, 19 bp, Artificial Sequence
  Synthetic polynucleotide
atctgctggtggatctgat

SEQ ID NO: 9631 - DNA, 20 bp, Artificial Sequence
  Synthetic polynucleotide
ctcttaactctcatggacgg

SEQ ID NO: 9632 - DNA, 20 bp, Artificial Sequence
  Synthetic polynucleotide
catttccacccctggattta

SEQ ID NO: 9633 - DNA, 20 bp, Artificial Sequence
  Synthetic polynucleotide
tttactgtcatctgtcgacc

SEQ ID NO: 9634 - DNA, 18 bp, Artificial Sequence
  Synthetic polynucleotide
ctgctgttgacgactctc

SEQ ID NO: 9635 - DNA, 20 bp, Artificial Sequence
  Synthetic polynucleotide
atgatactccagtggatcca

SEQ ID NO: 9636 - DNA, 20 bp, Artificial Sequence
  Synthetic polynucleotide
ttctgtgatattggttgggg

SEQ ID NO: 9637 - DNA, 20 bp, Artificial Sequence
  Synthetic polynucleotide
ccaaaaggtgtacaaaagcc

SEQ ID NO: 9638 - DNA, 20 bp, Artificial Sequence
  Synthetic polynucleotide
gtgttgctgattggattgag

SEQ ID NO: 9639 - DNA, 20 bp, Artificial Sequence
  Synthetic polynucleotide
gaagaagaagaagaagccca

SEQ ID NO: 9640 - DNA, 20 bp, Artificial Sequence
  Synthetic polynucleotide
acagtttcatcaggttctcc

SEQ ID NO: 9641 - DNA, 20 bp, Artificial Sequence
  Synthetic polynucleotide
aatggagatcaaacctggac

SEQ ID NO: 9642 - DNA, 20 bp, Artificial Sequence
  Synthetic polynucleotide
ctcgcttttctttttgggtt

SEQ ID NO: 9643 - DNA, 20 bp, Artificial Sequence
  Synthetic polynucleotide
acccttcagtaagataccga

SEQ ID NO: 9644 - DNA, 20 bp, Artificial Sequence
  Synthetic polynucleotide
aaattttcgtcggttatgcc

SEQ ID NO: 9645 - DNA, 20 bp, Artificial Sequence
  Synthetic polynucleotide
cgcatgtagcatcaaaagtt

SEQ ID NO: 9646 - DNA, 20 bp, Artificial Sequence
  Synthetic polynucleotide
tttgtaggttcgtcgaacat

SEQ ID NO: 9647 - DNA, 19 bp, Artificial Sequence
  Synthetic polynucleotide
ccgcagagaacgtttaaga

SEQ ID NO: 9648 - DNA, 19 bp, Artificial Sequence
  Synthetic polynucleotide
gtactggcatcattggagg

SEQ ID NO: 9649 - DNA, 20 bp, Artificial Sequence
  Synthetic polynucleotide
ggaaaattgattgaagccga

SEQ ID NO: 9650 - DNA, 18 bp, Artificial Sequence
  Synthetic polynucleotide
tcgaataggaggctgacc

SEQ ID NO: 9651 - DNA, 20 bp, Artificial Sequence
  Synthetic polynucleotide
aaaactgtagttgttgctgc

SEQ ID NO: 9652 - DNA, 20 bp, Artificial Sequence
  Synthetic polynucleotide
aaatctcctcccttatcgga

SEQ ID NO: 9653 - DNA, 20 bp, Artificial Sequence
  Synthetic polynucleotide
agaggacgaaaatgatcgaa

SEQ ID NO: 9654 - DNA, 20 bp, Artificial Sequence
  Synthetic polynucleotide
gttagtcgcatcactcgatt

SEQ ID NO: 9655 - DNA, 20 bp, Artificial Sequence
  Synthetic polynucleotide
atgacgactttatcacccag

SEQ ID NO: 9656 - DNA, 19 bp, Artificial Sequence
  Synthetic polynucleotide
acactatggcgaagttgtc

SEQ ID NO: 9657 - DNA, 20 bp, Artificial Sequence
  Synthetic polynucleotide
cctagaacaaccaggagatg

SEQ ID NO: 9658 - DNA, 19 bp, Artificial Sequence
  Synthetic polynucleotide
ttgtacaacaaagccagct

SEQ ID NO: 9659 - DNA, 20 bp, Artificial Sequence
  Synthetic polynucleotide
tttggttcagttgttgatgc

SEQ ID NO: 9660 - DNA, 20 bp, Artificial Sequence
  Synthetic polynucleotide
ctgatcgataccgtcaaagt

SEQ ID NO: 9661 - DNA, 20 bp, Artificial Sequence
  Synthetic polynucleotide
ggagaaagcgaaaaacacaa

SEQ ID NO: 9662 - DNA, 20 bp, Artificial Sequence
  Synthetic polynucleotide
tgagcaacaaatctttgctg

SEQ ID NO: 9663 - DNA, 20 bp, Artificial Sequence
  Synthetic polynucleotide
cggtgaattcgagaagaagt

SEQ ID NO: 9664 - DNA, 20 bp, Artificial Sequence
  Synthetic polynucleotide
ttcaatttgttgctgccaat

SEQ ID NO: 9665 - DNA, 20 bp, Artificial Sequence
  Synthetic polynucleotide
tatgtacagggtgggttttc

SEQ ID NO: 9666 - DNA, 20 bp, Artificial Sequence
  Synthetic polynucleotide
gctgccccgtttataataca

SEQ ID NO: 9667 - DNA, 20 bp, Artificial Sequence
  Synthetic polynucleotide
gaagaactaaaagcgaaggc

SEQ ID NO: 9668 - DNA, 20 bp, Artificial Sequence
  Synthetic polynucleotide
gcaaagcactcttttcttgt

SEQ ID NO: 9669 - DNA, 20 bp, Artificial Sequence
  Synthetic polynucleotide
caatgctcatccagacaaac

SEQ ID NO: 9670 - DNA, 20 bp, Artificial Sequence
  Synthetic polynucleotide
acaaatcctgagcagctatt

SEQ ID NO: 9671 - DNA, 20 bp, Artificial Sequence
  Synthetic polynucleotide
cttgtattcgaaagagcagc

SEQ ID NO: 9672 - DNA, 20 bp, Artificial Sequence
  Synthetic polynucleotide
agctctgataagggggttat

SEQ ID NO: 9673 - DNA, 21 bp, Artificial Sequence
  Synthetic polynucleotide
tcaaaagcctaaacagtttgt

SEQ ID NO: 9674 - DNA, 20 bp, Artificial Sequence
  Synthetic polynucleotide
gccaaacttcttatccctca

SEQ ID NO: 9675 - DNA, 20 bp, Artificial Sequence
  Synthetic polynucleotide
gtcaagagagcaccatagag

SEQ ID NO: 9676 - DNA, 20 bp, Artificial Sequence
  Synthetic polynucleotide
taaaagtccggtttcatcgt

SEQ ID NO: 9677 - DNA, 20 bp, Artificial Sequence
  Synthetic polynucleotide
atcgctccatcgataacaaa

SEQ ID NO: 9678 - DNA, 20 bp, Artificial Sequence
  Synthetic polynucleotide
aaaagcaaacgaaaccgaat

SEQ ID NO: 9679 - DNA, 20 bp, Artificial Sequence
  Synthetic polynucleotide
aaccgaatatttgtgcgaac

SEQ ID NO: 9680 - DNA, 20 bp, Artificial Sequence
  Synthetic polynucleotide
cgtagattgggtcgttgtat

SEQ ID NO: 9681 - DNA, 20 bp, Artificial Sequence
  Synthetic polynucleotide
gagaagtaggtgcaacatca

SEQ ID NO: 9682 - DNA, 20 bp, Artificial Sequence
  Synthetic polynucleotide
cggtcccaagaacttcttta

SEQ ID NO: 9683 - DNA, 20 bp, Artificial Sequence
  Synthetic polynucleotide
cgagcaaatggaagaagaac

SEQ ID NO: 9684 - DNA, 20 bp, Artificial Sequence
  Synthetic polynucleotide
tatggtggcatctcttagga

SEQ ID NO: 9685 - DNA, 20 bp, Artificial Sequence
  Synthetic polynucleotide
tcaatgaggtgttcaacgat

SEQ ID NO: 9686 - DNA, 20 bp, Artificial Sequence
  Synthetic polynucleotide
tctcagaaatcgcagtttga

SEQ ID NO: 9687 - DNA, 20 bp, Artificial Sequence
  Synthetic polynucleotide
atagtctccttaccgtccaa

SEQ ID NO: 9688 - DNA, 20 bp, Artificial Sequence
  Synthetic polynucleotide
atcgtcataatcggtttcgt

SEQ ID NO: 9689 - DNA, 20 bp, Artificial Sequence
  Synthetic polynucleotide
cgaagacaacctcgaaaaag

SEQ ID NO: 9690 - DNA, 20 bp, Artificial Sequence
  Synthetic polynucleotide
ttcaacctctttttcgttgc

SEQ ID NO: 9691 - DNA, 20 bp, Artificial Sequence
  Synthetic polynucleotide
ctagttttggggctacaact

SEQ ID NO: 9692 - DNA, 20 bp, Artificial Sequence
  Synthetic polynucleotide
cttcatctttgtgggactca

SEQ ID NO: 9693 - DNA, 20 bp, Artificial Sequence
  Synthetic polynucleotide
atctggcaagctactctttc

SEQ ID NO: 9694 - DNA, 20 bp, Artificial Sequence
  Synthetic polynucleotide
caaatctgacctggctactt

SEQ ID NO: 9695 - DNA, 20 bp, Artificial Sequence
  Synthetic polynucleotide
acacacaaacatggatcctt

SEQ ID NO: 9696 - DNA, 20 bp, Artificial Sequence
  Synthetic polynucleotide
tgatattcgctgagtcagtg

SEQ ID NO: 9697 - DNA, 20 bp, Artificial Sequence
  Synthetic polynucleotide
agaaggggaatcgataagga

SEQ ID NO: 9698 - DNA, 20 bp, Artificial Sequence
  Synthetic polynucleotide
cgggtaaaatcggttttcag

SEQ ID NO: 9699 - DNA, 20 bp, Artificial Sequence
  Synthetic polynucleotide
tgactctcagataagagcca

SEQ ID NO: 9700 - DNA, 20 bp, Artificial Sequence
  Synthetic polynucleotide
ttgatctttccccatcactg

SEQ ID NO: 9701 - DNA, 20 bp, Artificial Sequence
  Synthetic polynucleotide
gggaggcttatttgaggaaa

SEQ ID NO: 9702 - DNA, 20 bp, Artificial Sequence
  Synthetic polynucleotide
aagtcgataattcctggtcg

SEQ ID NO: 9703 - DNA, 20 bp, Artificial Sequence
  Synthetic polynucleotide
ggaggcaattcccaatatga

SEQ ID NO: 9704 - DNA, 21 bp, Artificial Sequence
  Synthetic polynucleotide
ctgcttgtatctatcagtcca

SEQ ID NO: 9705 - DNA, 20 bp, Artificial Sequence
  Synthetic polynucleotide
agttcgagataaactgctcg

SEQ ID NO: 9706 - DNA, 20 bp, Artificial Sequence
  Synthetic polynucleotide
ggtatgacgttcaagtcgta

SEQ ID NO: 9707 - DNA, 20 bp, Artificial Sequence
  Synthetic polynucleotide
aagtagttcataccgtgacg

SEQ ID NO: 9708 - DNA, 18 bp, Artificial Sequence
  Synthetic polynucleotide
ggtactccctcaggaact

SEQ ID NO: 9709 - DNA, 20 bp, Artificial Sequence
  Synthetic polynucleotide
actaagagccacagaagttg

SEQ ID NO: 9710 - DNA, 20 bp, Artificial Sequence
  Synthetic polynucleotide
gaacctccactgttggtaat

SEQ ID NO: 9711 - DNA, 20 bp, Artificial Sequence
  Synthetic polynucleotide
aattggtgattgttggtgac

SEQ ID NO: 9712 - DNA, 20 bp, Artificial Sequence
  Synthetic polynucleotide
ttctcgaaaacttctcggac

SEQ ID NO: 9713 - DNA, 20 bp, Artificial Sequence
  Synthetic polynucleotide
ggttaacagtggacagtgat

SEQ ID NO: 9714 - DNA, 20 bp, Artificial Sequence
  Synthetic polynucleotide
tcaccacggacatgtaaaat

SEQ ID NO: 9715 - DNA, 20 bp, Artificial Sequence
  Synthetic polynucleotide
ggtgctggcaaaagttttat

SEQ ID NO: 9716 - DNA, 20 bp, Artificial Sequence
  Synthetic polynucleotide
caaaatgccccattccaatt

SEQ ID NO: 9717 - DNA, 20 bp, Artificial Sequence
  Synthetic polynucleotide
ttccaaggaatcctacaagc

SEQ ID NO: 9718 - DNA, 20 bp, Artificial Sequence
  Synthetic polynucleotide
tgttggagtgtcatcgattt

SEQ ID NO: 9719 - DNA, 20 bp, Artificial Sequence
  Synthetic polynucleotide
tgaacccttttcagttcgaa

SEQ ID NO: 9720 - DNA, 20 bp, Artificial Sequence
  Synthetic polynucleotide
cctcgacactagatgtttgt

SEQ ID NO: 9721 - DNA, 20 bp, Artificial Sequence
  Synthetic polynucleotide
ggactaaccccaactttagg

SEQ ID NO: 9722 - DNA, 20 bp, Artificial Sequence
  Synthetic polynucleotide
caatcctgggtttcaccata

SEQ ID NO: 9723 - DNA, 20 bp, Artificial Sequence
  Synthetic polynucleotide
gttattccgacgaaatgagc

SEQ ID NO: 9724 - DNA, 20 bp, Artificial Sequence
  Synthetic polynucleotide
agacgacatagagctctgag

SEQ ID NO: 9725 - DNA, 20 bp, Artificial Sequence
  Synthetic polynucleotide
aaaataagcagggatgctca

SEQ ID NO: 9726 - DNA, 20 bp, Artificial Sequence
  Synthetic polynucleotide
ttgcctttgatcgtacatca

SEQ ID NO: 9727 - DNA, 20 bp, Artificial Sequence
  Synthetic polynucleotide
cgcgaaagatgggtatgtat

SEQ ID NO: 9728 - DNA, 20 bp, Artificial Sequence
  Synthetic polynucleotide
cgtgtcttcagcttaggaat

SEQ ID NO: 9729 - DNA, 20 bp, Artificial Sequence
  Synthetic polynucleotide
aagcccaagactatgaaagg

SEQ ID NO: 9730 - DNA, 20 bp, Artificial Sequence
  Synthetic polynucleotide
atgggtgttttcaaactcct

SEQ ID NO: 9731 - DNA, 20 bp, Artificial Sequence
  Synthetic polynucleotide
agccagaaagaaagatccaa

SEQ ID NO: 9732 - DNA, 20 bp, Artificial Sequence
  Synthetic polynucleotide
attttgtcttgtctggtggt

SEQ ID NO: 9733 - DNA, 21 bp, Artificial Sequence
  Synthetic polynucleotide
gaccgtttattaaggggtaca

SEQ ID NO: 9734 - DNA, 20 bp, Artificial Sequence
  Synthetic polynucleotide
cgccatcgaaatcagttcta

SEQ ID NO: 9735 - DNA, 20 bp, Artificial Sequence
  Synthetic polynucleotide
tgccctggatagatcagtta

SEQ ID NO: 9736 - DNA, 20 bp, Artificial Sequence
  Synthetic polynucleotide
acggctttaatgaacatcct

SEQ ID NO: 9737 - DNA, 20 bp, Artificial Sequence
  Synthetic polynucleotide
tgctagttttgggtatgcat

SEQ ID NO: 9738 - DNA, 20 bp, Artificial Sequence
  Synthetic polynucleotide
atttcacgcagtagggaatt

SEQ ID NO: 9739 - DNA, 20 bp, Artificial Sequence
  Synthetic polynucleotide
ccagcttgttgaggttagat

SEQ ID NO: 9740 - DNA, 19 bp, Artificial Sequence
  Synthetic polynucleotide
cggtcacaaagctgattga

SEQ ID NO: 9741 - DNA, 20 bp, Artificial Sequence
  Synthetic polynucleotide
ggcgctagaattgatgagta

SEQ ID NO: 9742 - DNA, 20 bp, Artificial Sequence
  Synthetic polynucleotide
aataaacctaaccctgccag

SEQ ID NO: 9743 - DNA, 20 bp, Artificial Sequence
  Synthetic polynucleotide
tgggggaaatagtcatgttg

SEQ ID NO: 9744 - DNA, 20 bp, Artificial Sequence
  Synthetic polynucleotide
ttcgaccagaattcgatacc

SEQ ID NO: 9745 - DNA, 20 bp, Artificial Sequence
  Synthetic polynucleotide
gatggacttggacaaagact

SEQ ID NO: 9746 - DNA, 20 bp, Artificial Sequence
  Synthetic polynucleotide
acaaagcaatagcatcctca

SEQ ID NO: 9747 - DNA, 18 bp, Artificial Sequence
  Synthetic polynucleotide
gtcactctgcaagactcg

SEQ ID NO: 9748 - DNA, 18 bp, Artificial Sequence
  Synthetic polynucleotide
gccccatccccatatttg

SEQ ID NO: 9749 - DNA, 20 bp, Artificial Sequence
  Synthetic polynucleotide
acatgctctgctatttggaa

SEQ ID NO: 9750 - DNA, 20 bp, Artificial Sequence
  Synthetic polynucleotide
tccattctccctcgataagt

SEQ ID NO: 9751 - DNA, 20 bp, Artificial Sequence
  Synthetic polynucleotide
agtccagctttttctcagag

SEQ ID NO: 9752 - DNA, 20 bp, Artificial Sequence
  Synthetic polynucleotide
ttttctttggtttcttcggc

SEQ ID NO: 9753 - DNA, 20 bp, Artificial Sequence
  Synthetic polynucleotide
aggttgagaagccacataag

SEQ ID NO: 9754 - DNA, 20 bp, Artificial Sequence
  Synthetic polynucleotide
gtttaggactgtagttgcca

SEQ ID NO: 9755 - DNA, 20 bp, Artificial Sequence
  Synthetic polynucleotide
tcgtctatgatcgtgaaacc

SEQ ID NO: 9756 - DNA, 20 bp, Artificial Sequence
  Synthetic polynucleotide
actcttggatccatagctct

SEQ ID NO: 9757 - DNA, 20 bp, Artificial Sequence
  Synthetic polynucleotide
gtctttctgagcaaattcgg

SEQ ID NO: 9758 - DNA, 20 bp, Artificial Sequence
  Synthetic polynucleotide
ccgttcagatctgatagcaa

SEQ ID NO: 9759 - DNA, 20 bp, Artificial Sequence
  Synthetic polynucleotide
taccaggtcgaatacgctat

SEQ ID NO: 9760 - DNA, 20 bp, Artificial Sequence
  Synthetic polynucleotide
aatgcttcaacttctttgcc

SEQ ID NO: 9761 - DNA, 20 bp, Artificial Sequence
  Synthetic polynucleotide
aaccaaaaacccctgaagat

SEQ ID NO: 9762 - DNA, 20 bp, Artificial Sequence
  Synthetic polynucleotide
gccaactcccaaaggtataa

SEQ ID NO: 9763 - DNA, 20 bp, Artificial Sequence
  Synthetic polynucleotide
aaactgcacagtactcgaat

SEQ ID NO: 9764 - DNA, 20 bp, Artificial Sequence
  Synthetic polynucleotide
gtgttgcttaatcgttgagg

SEQ ID NO: 9765 - DNA, 20 bp, Artificial Sequence
  Synthetic polynucleotide
caccacaacagattggacta

SEQ ID NO: 9766 - DNA, 20 bp, Artificial Sequence
  Synthetic polynucleotide
gagtccacagtgacatttct

SEQ ID NO: 9767 - DNA, 20 bp, Artificial Sequence
  Synthetic polynucleotide
gaagattcggtatccaagct

SEQ ID NO: 9768 - DNA, 20 bp, Artificial Sequence
  Synthetic polynucleotide
cagaaacagcatccctatca

SEQ ID NO: 9769 - DNA, 20 bp, Artificial Sequence
  Synthetic polynucleotide
gcaaacctgtagtactggaa

SEQ ID NO: 9770 - DNA, 20 bp, Artificial Sequence
  Synthetic polynucleotide
tgcacaaaaacatctccaac

SEQ ID NO: 9771 - DNA, 20 bp, Artificial Sequence
  Synthetic polynucleotide
ccatttagttgaatggcacc

SEQ ID NO: 9772 - DNA, 20 bp, Artificial Sequence
  Synthetic polynucleotide
gatttccaacaacatccgtc

SEQ ID NO: 9773 - DNA, 20 bp, Artificial Sequence
  Synthetic polynucleotide
gtttgggctcataatctgga

SEQ ID NO: 9774 - DNA, 20 bp, Artificial Sequence
  Synthetic polynucleotide
cccaagccatatagatgtcc

SEQ ID NO: 9775 - DNA, 20 bp, Artificial Sequence
  Synthetic polynucleotide
ttctccatttcgattctgca

SEQ ID NO: 9776 - DNA, 20 bp, Artificial Sequence
  Synthetic polynucleotide
cgattgtttggcaaatcgta

SEQ ID NO: 9777 - DNA, 20 bp, Artificial Sequence
  Synthetic polynucleotide
ggtaccacctcagtagtagt

SEQ ID NO: 9778 - DNA, 20 bp, Artificial Sequence
  Synthetic polynucleotide
cggatactaaattttcggcg

SEQ ID NO: 9779 - DNA, 20 bp, Artificial Sequence
  Synthetic polynucleotide
ggtcatcggccaatttttag

SEQ ID NO: 9780 - DNA, 20 bp, Artificial Sequence
  Synthetic polynucleotide
cgttggtggtttgatcaaaa

SEQ ID NO: 9781 - DNA, 20 bp, Artificial Sequence
  Synthetic polynucleotide
gctcagtgaccattaagaca

SEQ ID NO: 9782 - DNA, 20 bp, Artificial Sequence
  Synthetic polynucleotide
gtgacatccaacaaaccttt

SEQ ID NO: 9783 - DNA, 20 bp, Artificial Sequence
  Synthetic polynucleotide
atgactgcaagcaattaacg

SEQ ID NO: 9784 - DNA, 20 bp, Artificial Sequence
  Synthetic polynucleotide
agtgcatcatccaattccat

SEQ ID NO: 9785 - DNA, 20 bp, Artificial Sequence
  Synthetic polynucleotide
agaccaacagcgtcttattt

SEQ ID NO: 9786 - DNA, 20 bp, Artificial Sequence
  Synthetic polynucleotide
ctagttgtttgccagcaaaa

SEQ ID NO: 9787 - DNA, 20 bp, Artificial Sequence
  Synthetic polynucleotide
tcgtgagaaatggtaaagca

SEQ ID NO: 9788 - DNA, 20 bp, Artificial Sequence
  Synthetic polynucleotide
gaaagcacaacattagctcc

SEQ ID NO: 9789 - DNA, 20 bp, Artificial Sequence
  Synthetic polynucleotide
tgactatgtagacgcttgtg

SEQ ID NO: 9790 - DNA, 20 bp, Artificial Sequence
  Synthetic polynucleotide
catgatgattcaaagcaccc

SEQ ID NO: 9791 - DNA, 20 bp, Artificial Sequence
  Synthetic polynucleotide
aagggctattggtttgagag

SEQ ID NO: 9792 - DNA, 20 bp, Artificial Sequence
  Synthetic polynucleotide
tccatatctggacgatcgta

SEQ ID NO: 9793 - DNA, 20 bp, Artificial Sequence
  Synthetic polynucleotide
aaggaaaaggttacggtctc

SEQ ID NO: 9794 - DNA, 20 bp, Artificial Sequence
  Synthetic polynucleotide
gttcctggagatgttcttgt

SEQ ID NO: 9795 - DNA, 20 bp, Artificial Sequence
  Synthetic polynucleotide
aagaacgtatagaagacggc

SEQ ID NO: 9796 - DNA, 20 bp, Artificial Sequence
  Synthetic polynucleotide
ggtggtggaggtttaatgat

SEQ ID NO: 9797 - DNA, 20 bp, Artificial Sequence
  Synthetic polynucleotide
aaaatcggcaactccaaaag

SEQ ID NO: 9798 - DNA, 20 bp, Artificial Sequence
  Synthetic polynucleotide
cttcctttttgccttcttcg

SEQ ID NO: 9799 - DNA, 20 bp, Artificial Sequence
  Synthetic polynucleotide
cccattgacaaaaacgacaa

SEQ ID NO: 9800 - DNA, 20 bp, Artificial Sequence
  Synthetic polynucleotide
caaggcgtcttgtaaattcc

SEQ ID NO: 9801 - DNA, 20 bp, Artificial Sequence
  Synthetic polynucleotide
ggatttaatccctacgctga

SEQ ID NO: 9802 - DNA, 20 bp, Artificial Sequence
  Synthetic polynucleotide
cagcagctgaaataaacaca

SEQ ID NO: 9803 - DNA, 20 bp, Artificial Sequence
  Synthetic polynucleotide
ccaagtgctctagaacaact

SEQ ID NO: 9804 - DNA, 20 bp, Artificial Sequence
  Synthetic polynucleotide
cttcaccagagaacggttta

SEQ ID NO: 9805 - DNA, 20 bp, Artificial Sequence
  Synthetic polynucleotide
aaatgatggtgtctcctgac

SEQ ID NO: 9806 - DNA, 20 bp, Artificial Sequence
  Synthetic polynucleotide
gtagctccagcatttttcac

SEQ ID NO: 9807 - DNA, 20 bp, Artificial Sequence
  Synthetic polynucleotide
ggttcgaagtgaaaaagtgg

SEQ ID NO: 9808 - DNA, 20 bp, Artificial Sequence
  Synthetic polynucleotide
gtcttcaaccatctcgagat

SEQ ID NO: 9809 - DNA, 20 bp, Artificial Sequence
  Synthetic polynucleotide
gtttggctcgacaattaagg

SEQ ID NO: 9810 - DNA, 20 bp, Artificial Sequence
  Synthetic polynucleotide
ggatgctcttaattccgcta

SEQ ID NO: 9811 - DNA, 19 bp, Artificial Sequence
  Synthetic polynucleotide
tctgcaccaagtcgaatac

SEQ ID NO: 9812 - DNA, 20 bp, Artificial Sequence
  Synthetic polynucleotide
tcttctctcctcaccttcaa

SEQ ID NO: 9813 - DNA, 20 bp, Artificial Sequence
  Synthetic polynucleotide
gaaacttgtccagaagccta

SEQ ID NO: 9814 - DNA, 20 bp, Artificial Sequence
  Synthetic polynucleotide
ggttcaggatcctcatcatc

SEQ ID NO: 9815 - DNA, 20 bp, Artificial Sequence
  Synthetic polynucleotide
tcttgatgttggtgccaata

SEQ ID NO: 9816 - DNA, 20 bp, Artificial Sequence
  Synthetic polynucleotide
gcagaagcaatttggagaag

SEQ ID NO: 9817 - DNA, 20 bp, Artificial Sequence
  Synthetic polynucleotide
cacacgaaaaagaggaaagg

SEQ ID NO: 9818 - DNA, 20 bp, Artificial Sequence
  Synthetic polynucleotide
caacacctctaaccttaggc

SEQ ID NO: 9819 - DNA, 20 bp, Artificial Sequence
  Synthetic polynucleotide
gaaagctgcacgtaaaagtg

SEQ ID NO: 9820 - DNA, 20 bp, Artificial Sequence
  Synthetic polynucleotide
caaaggttagtgtcctcgaa

SEQ ID NO: 9821 - DNA, 20 bp, Artificial Sequence
  Synthetic polynucleotide
cctgattggtgaactcttga

SEQ ID NO: 9822 - DNA, 20 bp, Artificial Sequence
  Synthetic polynucleotide
ataaacgttccatgtttcgc

SEQ ID NO: 9823 - DNA, 20 bp, Artificial Sequence
  Synthetic polynucleotide
gctcatgccaatagagatca

SEQ ID NO: 9824 - DNA, 20 bp, Artificial Sequence
  Synthetic polynucleotide
ttgcaccacaattcaaagac

SEQ ID NO: 9825 - DNA, 20 bp, Artificial Sequence
  Synthetic polynucleotide
tccaaaaggatgaggatgtg

SEQ ID NO: 9826 - DNA, 20 bp, Artificial Sequence
  Synthetic polynucleotide
cgtcactctcttctgaaaca

SEQ ID NO: 9827 - DNA, 20 bp, Artificial Sequence
  Synthetic polynucleotide
tgacttgattgctgctaagt

SEQ ID NO: 9828 - DNA, 20 bp, Artificial Sequence
  Synthetic polynucleotide
ttctcatatagccaccctca

SEQ ID NO: 9829 - DNA, 20 bp, Artificial Sequence
  Synthetic polynucleotide
tccccagtacatttccaatg

SEQ ID NO: 9830 - DNA, 20 bp, Artificial Sequence
  Synthetic polynucleotide
aagttttctccttggtgtgt

SEQ ID NO: 9831 - DNA, 20 bp, Artificial Sequence
  Synthetic polynucleotide
aggaagttcgaattaggacg

SEQ ID NO: 9832 - DNA, 20 bp, Artificial Sequence
  Synthetic polynucleotide
ccttccaagatgtaaccgtc

SEQ ID NO: 9833 - DNA, 20 bp, Artificial Sequence
  Synthetic polynucleotide
aagttatgggtctcatgctg

SEQ ID NO: 9834 - DNA, 20 bp, Artificial Sequence
  Synthetic polynucleotide
catttttgatggccaactgt

SEQ ID NO: 9835 - DNA, 20 bp, Artificial Sequence
  Synthetic polynucleotide
gcgaagtagtcaaaccaatg

SEQ ID NO: 9836 - DNA, 20 bp, Artificial Sequence
  Synthetic polynucleotide
tttaaaatgtccaaacgggc

SEQ ID NO: 9837 - DNA, 20 bp, Artificial Sequence
  Synthetic polynucleotide
agctactttcaaagaggctc

SEQ ID NO: 9838 - DNA, 20 bp, Artificial Sequence
  Synthetic polynucleotide
actcaaaccttcagacttgg

SEQ ID NO: 9839 - DNA, 20 bp, Artificial Sequence
  Synthetic polynucleotide
taggttccactgctatagga

SEQ ID NO: 9840 - DNA, 20 bp, Artificial Sequence
  Synthetic polynucleotide
gagtcagagcctcttctact

SEQ ID NO: 9841 - DNA, 20 bp, Artificial Sequence
  Synthetic polynucleotide
tatttgaccaggttccagtg

SEQ ID NO: 9842 - DNA, 20 bp, Artificial Sequence
  Synthetic polynucleotide
acactaccatccaaatgtcc

SEQ ID NO: 9843 - DNA, 20 bp, Artificial Sequence
  Synthetic polynucleotide
ttgtaaagaagcctgcagat

SEQ ID NO: 9844 - DNA, 20 bp, Artificial Sequence
  Synthetic polynucleotide
tggcatcaaatgattcctca

SEQ ID NO: 9845 - DNA, 20 bp, Artificial Sequence
  Synthetic polynucleotide
agtacaacccaacgatttca

SEQ ID NO: 9846 - DNA, 20 bp, Artificial Sequence
  Synthetic polynucleotide
acaccttgatcagcatcaat

SEQ ID NO: 9847 - DNA, 20 bp, Artificial Sequence
  Synthetic polynucleotide
tcgaaggagatttgcttgaa

SEQ ID NO: 9848 - DNA, 20 bp, Artificial Sequence
  Synthetic polynucleotide
ctctcttttcactcgtttgc

SEQ ID NO: 9849 - DNA, 20 bp, Artificial Sequence
  Synthetic polynucleotide
gccagtgacaaagatttagc

SEQ ID NO: 9850 - DNA, 20 bp, Artificial Sequence
  Synthetic polynucleotide
agttgcacaaaacaaccaaa

SEQ ID NO: 9851 - DNA, 20 bp, Artificial Sequence
  Synthetic polynucleotide
aggctaaagtttgtcctcag

SEQ ID NO: 9852 - DNA, 20 bp, Artificial Sequence
  Synthetic polynucleotide
gattggacactgggagaaat

SEQ ID NO: 9853 - DNA, 20 bp, Artificial Sequence
  Synthetic polynucleotide
ggccaaagaagaaaaacgaa

SEQ ID NO: 9854 - DNA, 20 bp, Artificial Sequence
  Synthetic polynucleotide
cttcgccttgatccaaaatc

SEQ ID NO: 9855 - DNA, 20 bp, Artificial Sequence
  Synthetic polynucleotide
cagagccgagatcgaaaata

SEQ ID NO: 9856 - DNA, 20 bp, Artificial Sequence
  Synthetic polynucleotide
tacgaagtaattgccaacca

SEQ ID NO: 9857 - DNA, 20 bp, Artificial Sequence
  Synthetic polynucleotide
attctgttgaaggtctcacc

SEQ ID NO: 9858 - DNA, 20 bp, Artificial Sequence
  Synthetic polynucleotide
tggtagcagccattacaatt

SEQ ID NO: 9859 - DNA, 20 bp, Artificial Sequence
  Synthetic polynucleotide
aaaaatctgagcgacctcat

SEQ ID NO: 9860 - DNA, 20 bp, Artificial Sequence
  Synthetic polynucleotide
gctggaccgatcttaaacta

SEQ ID NO: 9861 - DNA, 20 bp, Artificial Sequence
  Synthetic polynucleotide
tggaagaaagtacgaaacgt

SEQ ID NO: 9862 - DNA, 20 bp, Artificial Sequence
  Synthetic polynucleotide
tcgcgattttaggctttttc

SEQ ID NO: 9863 - DNA, 20 bp, Artificial Sequence
  Synthetic polynucleotide
tcttcccattgtcttcaagg

SEQ ID NO: 9864 - DNA, 20 bp, Artificial Sequence
  Synthetic polynucleotide
agatgatgaaacgtccaaca

SEQ ID NO: 9865 - DNA, 20 bp, Artificial Sequence
  Synthetic polynucleotide
tttggatgacagactggaag

SEQ ID NO: 9866 - DNA, 20 bp, Artificial Sequence
  Synthetic polynucleotide
tgcaaaaggcttgtttgtag

SEQ ID NO: 9867 - DNA, 20 bp, Artificial Sequence
  Synthetic polynucleotide
cgaatgatgcaagcagaaat

SEQ ID NO: 9868 - DNA, 20 bp, Artificial Sequence
  Synthetic polynucleotide
tcttcttccacaatgtccag

SEQ ID NO: 9869 - DNA, 20 bp, Artificial Sequence
  Synthetic polynucleotide
tgaggatgatatctgcttgc

SEQ ID NO: 9870 - DNA, 20 bp, Artificial Sequence
  Synthetic polynucleotide
atttcgtcgttttcgtcaag

SEQ ID NO: 9871 - DNA, 20 bp, Artificial Sequence
  Synthetic polynucleotide
cgagtagtagacgctcaaaa

SEQ ID NO: 9872 - DNA, 20 bp, Artificial Sequence
  Synthetic polynucleotide
atctgcacataatcgctgat

SEQ ID NO: 9873 - DNA, 20 bp, Artificial Sequence
  Synthetic polynucleotide
agggaaagattgaggcaatt

SEQ ID NO: 9874 - DNA, 20 bp, Artificial Sequence
  Synthetic polynucleotide
attgaacattggaggtctcg

SEQ ID NO: 9875 - DNA, 20 bp, Artificial Sequence
  Synthetic polynucleotide
tgacctgcgaaactattacc

SEQ ID NO: 9876 - DNA, 20 bp, Artificial Sequence
  Synthetic polynucleotide
cacttgagctcgaagtatcc

SEQ ID NO: 9877 - DNA, 20 bp, Artificial Sequence
  Synthetic polynucleotide
cgaaacgagcgaaaatctag

SEQ ID NO: 9878 - DNA, 20 bp, Artificial Sequence
  Synthetic polynucleotide
cctgtgtctgaataggtagc

SEQ ID NO: 9879 - DNA, 20 bp, Artificial Sequence
  Synthetic polynucleotide
caacgaaatcgaacacgaaa

SEQ ID NO: 9880 - DNA, 20 bp, Artificial Sequence
  Synthetic polynucleotide
tgactaccctagacatggtt

SEQ ID NO: 9881 - DNA, 20 bp, Artificial Sequence
  Synthetic polynucleotide
ttgacgtcatgaactccatt

SEQ ID NO: 9882 - DNA, 20 bp, Artificial Sequence
  Synthetic polynucleotide
agcaagcatacagttggtta

SEQ ID NO: 9883 - DNA, 20 bp, Artificial Sequence
  Synthetic polynucleotide
gcggataaagaaacccaaac

SEQ ID NO: 9884 - DNA, 20 bp, Artificial Sequence
  Synthetic polynucleotide
gaaaattccgaatccgtgac

SEQ ID NO: 9885 - DNA, 20 bp, Artificial Sequence
  Synthetic polynucleotide
agactattgaatccgccatc

SEQ ID NO: 9886 - DNA, 20 bp, Artificial Sequence
  Synthetic polynucleotide
ggtatctggtcatagccttg

SEQ ID NO: 9887 - DNA, 20 bp, Artificial Sequence
  Synthetic polynucleotide
agcttgtatgcatgtgagaa

SEQ ID NO: 9888 - DNA, 20 bp, Artificial Sequence
  Synthetic polynucleotide
ggcttgttcgatttcttgtt

SEQ ID NO: 9889 - DNA, 20 bp, Artificial Sequence
  Synthetic polynucleotide
aaaaccacctttgtaaagcg

SEQ ID NO: 9890 - DNA, 20 bp, Artificial Sequence
  Synthetic polynucleotide
catgtgtacttctggtggta

SEQ ID NO: 9891 - DNA, 20 bp, Artificial Sequence
  Synthetic polynucleotide
agagaggttgcttctgaaag

SEQ ID NO: 9892 - DNA, 20 bp, Artificial Sequence
  Synthetic polynucleotide
agttcttctgctttctggag

SEQ ID NO: 9893 - DNA, 20 bp, Artificial Sequence
  Synthetic polynucleotide
ttgcacatccagacaaattg

SEQ ID NO: 9894 - DNA, 20 bp, Artificial Sequence
  Synthetic polynucleotide
gaagatcttgtgcagcaatc

SEQ ID NO: 9895 - DNA, 20 bp, Artificial Sequence
  Synthetic polynucleotide
agctggaaagatttcagagg

SEQ ID NO: 9896 - DNA, 20 bp, Artificial Sequence
  Synthetic polynucleotide
accacatttccctgagaatc

SEQ ID NO: 9897 - DNA, 20 bp, Artificial Sequence
  Synthetic polynucleotide
aattgaagccgggactaaat

SEQ ID NO: 9898 - DNA, 20 bp, Artificial Sequence
  Synthetic polynucleotide
tgccaccaaatccaaatttc

SEQ ID NO: 9899 - DNA, 20 bp, Artificial Sequence
  Synthetic polynucleotide
cacttcgaaactgaagaagc

SEQ ID NO: 9900 - DNA, 20 bp, Artificial Sequence
  Synthetic polynucleotide
tgcatgtattgggatgtcaa

SEQ ID NO: 9901 - DNA, 20 bp, Artificial Sequence
  Synthetic polynucleotide
aaatctcgatacactggacg

SEQ ID NO: 9902 - DNA, 20 bp, Artificial Sequence
  Synthetic polynucleotide
tgttgtgattccgaagatgt

SEQ ID NO: 9903 - DNA, 20 bp, Artificial Sequence
  Synthetic polynucleotide
gaagtaggagccacatcatc

SEQ ID NO: 9904 - DNA, 20 bp, Artificial Sequence
  Synthetic polynucleotide
gtgccttaccatcaattgtg

SEQ ID NO: 9905 - DNA, 20 bp, Artificial Sequence
  Synthetic polynucleotide
gaactagccgatgaagctaa

SEQ ID NO: 9906 - DNA, 20 bp, Artificial Sequence
  Synthetic polynucleotide
cttcgattactacacctggg

SEQ ID NO: 9907 - DNA, 20 bp, Artificial Sequence
  Synthetic polynucleotide
ggcgagtttaacgaggtatt

SEQ ID NO: 9908 - DNA, 20 bp, Artificial Sequence
  Synthetic polynucleotide
tacgtgtgactggcaataat

SEQ ID NO: 9909 - DNA, 20 bp, Artificial Sequence
  Synthetic polynucleotide
tacaaacgaaaacgcaaaca

SEQ ID NO: 9910 - DNA, 20 bp, Artificial Sequence
  Synthetic polynucleotide
atcgttgaaccattgagaca

SEQ ID NO: 9911 - DNA, 20 bp, Artificial Sequence
  Synthetic polynucleotide
aatccttgggtcagtaggta

SEQ ID NO: 9912 - DNA, 20 bp, Artificial Sequence
  Synthetic polynucleotide
ggactctttcttctcttcgg

SEQ ID NO: 9913 - DNA, 20 bp, Artificial Sequence
  Synthetic polynucleotide
agaagtcataaatgctgcca

SEQ ID NO: 9914 - DNA, 20 bp, Artificial Sequence
  Synthetic polynucleotide
tagccacttctctgtcaaac

SEQ ID NO: 9915 - DNA, 20 bp, Artificial Sequence
  Synthetic polynucleotide
aggatttggtggttttggat

SEQ ID NO: 9916 - DNA, 20 bp, Artificial Sequence
  Synthetic polynucleotide
gatttgaagtgtcctggtct

SEQ ID NO: 9917 - DNA, 20 bp, Artificial Sequence
  Synthetic polynucleotide
cttcctgggtctggataatg

SEQ ID NO: 9918 - DNA, 20 bp, Artificial Sequence
  Synthetic polynucleotide
agcacataaagagttccagg

SEQ ID NO: 9919 - DNA, 20 bp, Artificial Sequence
  Synthetic polynucleotide
aatattgcccaaggaaacct

SEQ ID NO: 9920 - DNA, 20 bp, Artificial Sequence
  Synthetic polynucleotide
gaggtggtgatgtcattgta

SEQ ID NO: 9921 - DNA, 20 bp, Artificial Sequence
  Synthetic polynucleotide
aggagacagagcttcttttg

SEQ ID NO: 9922 - DNA, 20 bp, Artificial Sequence
  Synthetic polynucleotide
tcggaaaccatcgttaaagt

SEQ ID NO: 9923 - DNA, 20 bp, Artificial Sequence
  Synthetic polynucleotide
cgtgtaaagtacagcaacac

SEQ ID NO: 9924 - DNA, 20 bp, Artificial Sequence
  Synthetic polynucleotide
caacaaattgctcaccactt

SEQ ID NO: 9925 - DNA, 20 bp, Artificial Sequence
  Synthetic polynucleotide
tatgaactcgtttgccaaga

SEQ ID NO: 9926 - DNA, 20 bp, Artificial Sequence
  Synthetic polynucleotide
gcaaagtgagactcctgtaa

SEQ ID NO: 9927 - DNA, 20 bp, Artificial Sequence
  Synthetic polynucleotide
tgtgggtttagctcagttac

SEQ ID NO: 9928 - DNA, 20 bp, Artificial Sequence
  Synthetic polynucleotide
tacttgcatatggtttgcct

SEQ ID NO: 9929 - DNA, 20 bp, Artificial Sequence
  Synthetic polynucleotide
cgcgatgtttctacgtttag

SEQ ID NO: 9930 - DNA, 20 bp, Artificial Sequence
  Synthetic polynucleotide
tagatcaggagtggccatta

SEQ ID NO: 9931 - DNA, 20 bp, Artificial Sequence
  Synthetic polynucleotide
ggcggaaaaatgattgagag

SEQ ID NO: 9932 - DNA, 20 bp, Artificial Sequence
  Synthetic polynucleotide
aatcaaactggacgtcatga

SEQ ID NO: 9933 - DNA, 20 bp, Artificial Sequence
  Synthetic polynucleotide
ggatgttcagaaggtccatt

SEQ ID NO: 9934 - DNA, 20 bp, Artificial Sequence
  Synthetic polynucleotide
gctattgctgtgacaaactc

SEQ ID NO: 9935 - DNA, 20 bp, Artificial Sequence
  Synthetic polynucleotide
agtaattgtcggtgatggag

SEQ ID NO: 9936 - DNA, 20 bp, Artificial Sequence
  Synthetic polynucleotide
ccttccttgcttttagctga

SEQ ID NO: 9937 - DNA, 20 bp, Artificial Sequence
  Synthetic polynucleotide
acacaacggcttgtacttat

SEQ ID NO: 9938 - DNA, 20 bp, Artificial Sequence
  Synthetic polynucleotide
tattgtcggggtctatcctt

SEQ ID NO: 9939 - DNA, 20 bp, Artificial Sequence
  Synthetic polynucleotide
cagtgtctatatgcgtccaa

SEQ ID NO: 9940 - DNA, 20 bp, Artificial Sequence
  Synthetic polynucleotide
caagctttggttgcaaagta

SEQ ID NO: 9941 - DNA, 20 bp, Artificial Sequence
  Synthetic polynucleotide
gtttgttagtaggcacagga

SEQ ID NO: 9942 - DNA, 20 bp, Artificial Sequence
  Synthetic polynucleotide
tactggcttctccaaaactc

SEQ ID NO: 9943 - DNA, 20 bp, Artificial Sequence
  Synthetic polynucleotide
gaacccgtttcaattcgaaa

SEQ ID NO: 9944 - DNA, 20 bp, Artificial Sequence
  Synthetic polynucleotide
tagtggcgggataggtatag

SEQ ID NO: 9945 - DNA, 20 bp, Artificial Sequence
  Synthetic polynucleotide
gcaaccaataacaagtcagg

SEQ ID NO: 9946 - DNA, 20 bp, Artificial Sequence
  Synthetic polynucleotide
tgagtcagcactaaaccttc

SEQ ID NO: 9947 - DNA, 20 bp, Artificial Sequence
  Synthetic polynucleotide
gctacgctgaagaaatgaac

SEQ ID NO: 9948 - DNA, 21 bp, Artificial Sequence
  Synthetic polynucleotide
gctgaagaaagttgactttgt

SEQ ID NO: 9949 - DNA, 20 bp, Artificial Sequence
  Synthetic polynucleotide
tgaaagaataagccgttcca

SEQ ID NO: 9950 - DNA, 20 bp, Artificial Sequence
  Synthetic polynucleotide
gcatcttgcttcttctgttc

SEQ ID NO: 9951 - DNA, 20 bp, Artificial Sequence
  Synthetic polynucleotide
gaaagatgggtttgcctcta

SEQ ID NO: 9952 - DNA, 20 bp, Artificial Sequence
  Synthetic polynucleotide
gtttatgcaaacgcgttttc

SEQ ID NO: 9953 - DNA, 20 bp, Artificial Sequence
  Synthetic polynucleotide
ctacgaagaactagaagccc

SEQ ID NO: 9954 - DNA, 20 bp, Artificial Sequence
  Synthetic polynucleotide
attctcttgggcatcatgtt

SEQ ID NO: 9955 - DNA, 20 bp, Artificial Sequence
  Synthetic polynucleotide
accgggcattatttaatggt

SEQ ID NO: 9956 - DNA, 20 bp, Artificial Sequence
  Synthetic polynucleotide
gtaaaggaaagcgtgaactg

SEQ ID NO: 9957 - DNA, 20 bp, Artificial Sequence
  Synthetic polynucleotide
cttctacgcctctcatgtac

SEQ ID NO: 9958 - DNA, 20 bp, Artificial Sequence
  Synthetic polynucleotide
gcctcttcctgcatcataat

SEQ ID NO: 9959 - DNA, 20 bp, Artificial Sequence
  Synthetic polynucleotide
aagaaaagcactggttggta

SEQ ID NO: 9960 - DNA, 20 bp, Artificial Sequence
  Synthetic polynucleotide
aaatggtgaaaatgccgatc

SEQ ID NO: 9961 - DNA, 20 bp, Artificial Sequence
  Synthetic polynucleotide
tttttccgcaaaaaccctac

SEQ ID NO: 9962 - DNA, 20 bp, Artificial Sequence
  Synthetic polynucleotide
aatagctgagacgcctttag

SEQ ID NO: 9963 - DNA, 20 bp, Artificial Sequence
  Synthetic polynucleotide
agctcctcttgctgtaaaaa

SEQ ID NO: 9964 - DNA, 19 bp, Artificial Sequence
  Synthetic polynucleotide
ccccagtgtttacggattt

SEQ ID NO: 9965 - DNA, 20 bp, Artificial Sequence
  Synthetic polynucleotide
tcttcgagtctctggtatgt

SEQ ID NO: 9966 - DNA, 20 bp, Artificial Sequence
  Synthetic polynucleotide
gataatgcggcaattccaaa

SEQ ID NO: 9967 - DNA, 20 bp, Artificial Sequence
  Synthetic polynucleotide
aagccatgccaacactaata

SEQ ID NO: 9968 - DNA, 20 bp, Artificial Sequence
  Synthetic polynucleotide
gactccaccacttttgtttg

SEQ ID NO: 9969 - DNA, 20 bp, Artificial Sequence
  Synthetic polynucleotide
aatgagatcagtgtgccaat

SEQ ID NO: 9970 - DNA, 20 bp, Artificial Sequence
  Synthetic polynucleotide
ccgttggacgttttctttag

SEQ ID NO: 9971 - DNA, 20 bp, Artificial Sequence
  Synthetic polynucleotide
acgactctcgaacgtttatt

SEQ ID NO: 9972 - DNA, 20 bp, Artificial Sequence
  Synthetic polynucleotide
ggacctctaattcccattgg

SEQ ID NO: 9973 - DNA, 20 bp, Artificial Sequence
  Synthetic polynucleotide
attacacatatcgactgggc

SEQ ID NO: 9974 - DNA, 20 bp, Artificial Sequence
  Synthetic polynucleotide
ttacacgaacaaagttgtgc

SEQ ID NO: 9975 - DNA, 20 bp, Artificial Sequence
  Synthetic polynucleotide
tgtgggtttagctcagttac

SEQ ID NO: 9976 - DNA, 20 bp, Artificial Sequence
  Synthetic polynucleotide
tacttgcatatggtttgcct

SEQ ID NO: 9977 - DNA, 20 bp, Artificial Sequence
  Synthetic polynucleotide
gagacgacaagagagagaac

SEQ ID NO: 9978 - DNA, 20 bp, Artificial Sequence
  Synthetic polynucleotide
tccgctttgagtaattccaa

SEQ ID NO: 9979 - DNA, 20 bp, Artificial Sequence
  Synthetic polynucleotide
cagtggaatctgataaggca

SEQ ID NO: 9980 - DNA, 20 bp, Artificial Sequence
  Synthetic polynucleotide
gttcctcggaaagttgtagt

SEQ ID NO: 9981 - DNA, 20 bp, Artificial Sequence
  Synthetic polynucleotide
tggtcagattgttggagaag

SEQ ID NO: 9982 - DNA, 20 bp, Artificial Sequence
  Synthetic polynucleotide
aagagcagggtctaaggtat

SEQ ID NO: 9983 - DNA, 20 bp, Artificial Sequence
  Synthetic polynucleotide
gaagcaataagtcatgcagg

SEQ ID NO: 9984 - DNA, 20 bp, Artificial Sequence
  Synthetic polynucleotide
cttgaacctcttcagtaggt

SEQ ID NO: 9985 - DNA, 20 bp, Artificial Sequence
  Synthetic polynucleotide
attggggccatgaatatgtt

SEQ ID NO: 9986 - DNA, 20 bp, Artificial Sequence
  Synthetic polynucleotide
atacatccacttgttgccat

SEQ ID NO: 9987 - DNA, 20 bp, Artificial Sequence
  Synthetic polynucleotide
tcagtgcacaggttacttac

SEQ ID NO: 9988 - DNA, 20 bp, Artificial Sequence
  Synthetic polynucleotide
gtctagtaggtcgttgtcac

SEQ ID NO: 9989 - DNA, 20 bp, Artificial Sequence
  Synthetic polynucleotide
ctcttctccaaggcatatcc

SEQ ID NO: 9990 - DNA, 20 bp, Artificial Sequence
  Synthetic polynucleotide
tgttagtcgtaggtccagat

SEQ ID NO: 9991 - DNA, 20 bp, Artificial Sequence
  Synthetic polynucleotide
gtgttgctattgcttcagac

SEQ ID NO: 9992 - DNA, 20 bp, Artificial Sequence
  Synthetic polynucleotide
gtcacaagcattaacaaggg

SEQ ID NO: 9993 - DNA, 20 bp, Artificial Sequence
  Synthetic polynucleotide
caggcgatgactcttaatga

SEQ ID NO: 9994 - DNA, 20 bp, Artificial Sequence
  Synthetic polynucleotide
ctatgtgtgtgtttggagga

SEQ ID NO: 9995 - DNA, 20 bp, Artificial Sequence
  Synthetic polynucleotide
ggaagtagtggcaagaagaa

SEQ ID NO: 9996 - DNA, 20 bp, Artificial Sequence
  Synthetic polynucleotide
tcatccttggacaactgaag

SEQ ID NO: 9997 - DNA, 21 bp, Artificial Sequence
  Synthetic polynucleotide
accctagaagaattagagcag

SEQ ID NO: 9998 - DNA, 20 bp, Artificial Sequence
  Synthetic polynucleotide
gcatatgcaacttgttccaa

SEQ ID NO: 9999 - DNA, 20 bp, Artificial Sequence
  Synthetic polynucleotide
gacactgaatttcctggagt

SEQ ID NO: 10000 - DNA, 20 bp, Artificial Sequence
  Synthetic polynucleotide
cgtataagtgaccgcagtat

SEQ ID NO: 10001 - DNA, 20 bp, Artificial Sequence
  Synthetic polynucleotide
acaagggacactcaagtttt

SEQ ID NO: 10002 - DNA, 20 bp, Artificial Sequence
  Synthetic polynucleotide
catcaatacctctagcccac

SEQ ID NO: 10003 - DNA, 20 bp, Artificial Sequence
  Synthetic polynucleotide
tgatgaaccgtggaattcat

SEQ ID NO: 10004 - DNA, 20 bp, Artificial Sequence
  Synthetic polynucleotide
gtcactttgacgatacgaga

SEQ ID NO: 10005 - DNA, 20 bp, Artificial Sequence
  Synthetic polynucleotide
gcttcaagctgatgagaaac

SEQ ID NO: 10006 - DNA, 20 bp, Artificial Sequence
  Synthetic polynucleotide
aatctttcgcaaggacgata

SEQ ID NO: 10007 - DNA, 21 bp, Artificial Sequence
  Synthetic polynucleotide
ttgcaaaatgttcagtaacca

SEQ ID NO: 10008 - DNA, 20 bp, Artificial Sequence
  Synthetic polynucleotide
acgaatttcttccggagttt

SEQ ID NO: 10009 - DNA, 20 bp, Artificial Sequence
  Synthetic polynucleotide
ggagtcaaatgtgcaagaag

SEQ ID NO: 10010 - DNA, 20 bp, Artificial Sequence
  Synthetic polynucleotide
tccaactccattatagctgc

SEQ ID NO: 10011 - DNA, 20 bp, Artificial Sequence
  Synthetic polynucleotide
aggcatgcagatctttgtta

SEQ ID NO: 10012 - DNA, 20 bp, Artificial Sequence
  Synthetic polynucleotide
tgacaaaaatttgcatgcct

SEQ ID NO: 10013 - DNA, 20 bp, Artificial Sequence
  Synthetic polynucleotide
tgtggatggtaatgggaaag

SEQ ID NO: 10014 - DNA, 20 bp, Artificial Sequence
  Synthetic polynucleotide
acatcgcctattggaagttt

SEQ ID NO: 10015 - DNA, 20 bp, Artificial Sequence
  Synthetic polynucleotide
aacaggaagcagagaagaag

SEQ ID NO: 10016 - DNA, 20 bp, Artificial Sequence
  Synthetic polynucleotide
atcaaccttagcttgaacgt

SEQ ID NO: 10017 - DNA, 20 bp, Artificial Sequence
  Synthetic polynucleotide
gaggaggaacagatgtcatc

SEQ ID NO: 10018 - DNA, 20 bp, Artificial Sequence
  Synthetic polynucleotide
gagaatttttctgcgtccag

SEQ ID NO: 10019 - DNA, 20 bp, Artificial Sequence
  Synthetic polynucleotide
tgaaggtgaagttacagagc

SEQ ID NO: 10020 - DNA, 20 bp, Artificial Sequence
  Synthetic polynucleotide
ggtagtccatgtggtgaaat

SEQ ID NO: 10021 - DNA, 20 bp, Artificial Sequence
  Synthetic polynucleotide
gtgaatttgtgcgcatagaa

SEQ ID NO: 10022 - DNA, 20 bp, Artificial Sequence
  Synthetic polynucleotide
cacaatacaccaccagagaa

SEQ ID NO: 10023 - DNA, 20 bp, Artificial Sequence
  Synthetic polynucleotide
aattggtctgttggatcctc

SEQ ID NO: 10024 - DNA, 20 bp, Artificial Sequence
  Synthetic polynucleotide
aactgagcttctggtacaag

SEQ ID NO: 10025 - DNA, 20 bp, Artificial Sequence
  Synthetic polynucleotide
tagttttgcagtgccatttg

SEQ ID NO: 10026 - DNA, 20 bp, Artificial Sequence
  Synthetic polynucleotide
tgatcagattatgcaaggca

SEQ ID NO: 10027 - DNA, 20 bp, Artificial Sequence
  Synthetic polynucleotide
cacaagatgaagaggttgga

SEQ ID NO: 10028 - DNA, 20 bp, Artificial Sequence
  Synthetic polynucleotide
agcaccacaaccaatatgat

SEQ ID NO: 10029 - DNA, 20 bp, Artificial Sequence
  Synthetic polynucleotide
tgcaccttcttttagtccat

SEQ ID NO: 10030 - DNA, 21 bp, Artificial Sequence
  Synthetic polynucleotide
aatatctctttcagcagctga

SEQ ID NO: 10031 - DNA, 20 bp, Artificial Sequence
  Synthetic polynucleotide
gggaatgaaagggatgatgt

SEQ ID NO: 10032 - DNA, 20 bp, Artificial Sequence
  Synthetic polynucleotide
cttctttaacaggttgacgc

SEQ ID NO: 10033 - DNA, 20 bp, Artificial Sequence
  Synthetic polynucleotide
agctaccatcatgaagcaaa

SEQ ID NO: 10034 - DNA, 20 bp, Artificial Sequence
  Synthetic polynucleotide
ctgcaggaagttctctcttt

SEQ ID NO: 10035 - DNA, 20 bp, Artificial Sequence
  Synthetic polynucleotide
gcagtggaaaaggtgaaaaa

SEQ ID NO: 10036 - DNA, 20 bp, Artificial Sequence
  Synthetic polynucleotide
catgattacaaacaccccac

SEQ ID NO: 10037 - DNA, 20 bp, Artificial Sequence
  Synthetic polynucleotide
tggacaagaaagttggtcaa

SEQ ID NO: 10038 - DNA, 20 bp, Artificial Sequence
  Synthetic polynucleotide
gcaaaggattccatagcaac

SEQ ID NO: 10039 - DNA, 20 bp, Artificial Sequence
  Synthetic polynucleotide
ccggttacatcaggttgaat

SEQ ID NO: 10040 - DNA, 20 bp, Artificial Sequence
  Synthetic polynucleotide
tatcgccacttcttctctct

SEQ ID NO: 10041 - DNA, 20 bp, Artificial Sequence
  Synthetic polynucleotide
caaggaatggggtgaacata

SEQ ID NO: 10042 - DNA, 20 bp, Artificial Sequence
  Synthetic polynucleotide
tgccttttcaaaaagtccac

SEQ ID NO: 10043 - DNA, 20 bp, Artificial Sequence
  Synthetic polynucleotide
gagttatttgttcaagccgg

SEQ ID NO: 10044 - DNA, 20 bp, Artificial Sequence
  Synthetic polynucleotide
tttgtttgtaggtggtggag

SEQ ID NO: 10045 - DNA, 20 bp, Artificial Sequence
  Synthetic polynucleotide
tgaggtctttagatttcgct

SEQ ID NO: 10046 - DNA, 20 bp, Artificial Sequence
  Synthetic polynucleotide
taagaccaacctttctaccg

SEQ ID NO: 10047 - DNA, 18 bp, Artificial Sequence
  Synthetic polynucleotide
ggggtgttaagaagcctc

SEQ ID NO: 10048 - DNA, 18 bp, Artificial Sequence
  Synthetic polynucleotide
tgatggtcaccctcttgg

SEQ ID NO: 10049 - DNA, 20 bp, Artificial Sequence
  Synthetic polynucleotide
ctccctgataaacccctaga

SEQ ID NO: 10050 - DNA, 20 bp, Artificial Sequence
  Synthetic polynucleotide
tacaccaccatcttcaactg

SEQ ID NO: 10051 - DNA, 20 bp, Artificial Sequence
  Synthetic polynucleotide
gaatgttgaggtccctgaat

SEQ ID NO: 10052 - DNA, 20 bp, Artificial Sequence
  Synthetic polynucleotide
aaactctacgaaccacttcc

SEQ ID NO: 10053 - DNA, 20 bp, Artificial Sequence
  Synthetic polynucleotide
aatagttgattgcggctttg

SEQ ID NO: 10054 - DNA, 20 bp, Artificial Sequence
  Synthetic polynucleotide
tcacataacagttgagccaa

SEQ ID NO: 10055 - DNA, 20 bp, Artificial Sequence
  Synthetic polynucleotide
ctttctgtatcagtcctccg

SEQ ID NO: 10056 - DNA, 20 bp, Artificial Sequence
  Synthetic polynucleotide
acgaaatatctgtcggtctg

SEQ ID NO: 10057 - DNA, 20 bp, Artificial Sequence
  Synthetic polynucleotide
agaaaattttgtgcgcttca

SEQ ID NO: 10058 - DNA, 20 bp, Artificial Sequence
  Synthetic polynucleotide
caccttctttctgagcttct

SEQ ID NO: 10059 - DNA, 20 bp, Artificial Sequence
  Synthetic polynucleotide
aacccatcagaaagaagagg

SEQ ID NO: 10060 - DNA, 20 bp, Artificial Sequence
  Synthetic polynucleotide
ccctcaaggatgtaaccatc

SEQ ID NO: 10061 - DNA, 20 bp, Artificial Sequence
  Synthetic polynucleotide
ttctctggctctccttaaga

SEQ ID NO: 10062 - DNA, 20 bp, Artificial Sequence
  Synthetic polynucleotide
atcttgcttaccaacgttct

SEQ ID NO: 10063 - DNA, 20 bp, Artificial Sequence
  Synthetic polynucleotide
tcgttaaagtgcatcctgaa

SEQ ID NO: 10064 - DNA, 20 bp, Artificial Sequence
  Synthetic polynucleotide
gaagagcagggtccaaaata

SEQ ID NO: 10065 - DNA, 20 bp, Artificial Sequence
  Synthetic polynucleotide
tggttgaagacagcttatga

SEQ ID NO: 10066 - DNA, 20 bp, Artificial Sequence
  Synthetic polynucleotide
gtctaatttctctcctcgct

SEQ ID NO: 10067 - DNA, 20 bp, Artificial Sequence
  Synthetic polynucleotide
tttcaagtggagtatgccat

SEQ ID NO: 10068 - DNA, 21 bp, Artificial Sequence
  Synthetic polynucleotide
acgaaattgtttctcttctgc

SEQ ID NO: 10069 - DNA, 20 bp, Artificial Sequence
  Synthetic polynucleotide
gatcaggtcactcacaaagt

SEQ ID NO: 10070 - DNA, 20 bp, Artificial Sequence
  Synthetic polynucleotide
caacgaactagaggtccaaa

SEQ ID NO: 10071 - DNA, 20 bp, Artificial Sequence
  Synthetic polynucleotide
tatgcccttaattgcatggt

SEQ ID NO: 10072 - DNA, 20 bp, Artificial Sequence
  Synthetic polynucleotide
atttagcgtactcagcgatt

SEQ ID NO: 10073 - DNA, 20 bp, Artificial Sequence
  Synthetic polynucleotide
acagcacacttgaagatcat

SEQ ID NO: 10074 - DNA, 20 bp, Artificial Sequence
  Synthetic polynucleotide
gttgcaattcggaacttagg

SEQ ID NO: 10075 - DNA, 20 bp, Artificial Sequence
  Synthetic polynucleotide
gtattgatcagcgttctcct

SEQ ID NO: 10076 - DNA, 20 bp, Artificial Sequence
  Synthetic polynucleotide
acttagtgcgaactccaaat

SEQ ID NO: 10077 - DNA, 20 bp, Artificial Sequence
  Synthetic polynucleotide
ccgatgaagagccataatga

SEQ ID NO: 10078 - DNA, 20 bp, Artificial Sequence
  Synthetic polynucleotide
ccttcccaacgtctctttaa

SEQ ID NO: 10079 - DNA, 20 bp, Artificial Sequence
  Synthetic polynucleotide
gtattagcgtggagaaggag

SEQ ID NO: 10080 - DNA, 20 bp, Artificial Sequence
  Synthetic polynucleotide
tctctgaagggagaatgcta

SEQ ID NO: 10081 - DNA, 20 bp, Artificial Sequence
  Synthetic polynucleotide
agtgcgttctttggtagatt

SEQ ID NO: 10082 - DNA, 20 bp, Artificial Sequence
  Synthetic polynucleotide
gagctcgtacaattggatct

SEQ ID NO: 10083 - DNA, 20 bp, Artificial Sequence
  Synthetic polynucleotide
aaatgctgtgcaaaccttac

SEQ ID NO: 10084 - DNA, 20 bp, Artificial Sequence
  Synthetic polynucleotide
agtacgtttccttttcctcc

SEQ ID NO: 10085 - DNA, 20 bp, Artificial Sequence
  Synthetic polynucleotide
attgttatggctgctaccaa

SEQ ID NO: 10086 - DNA, 20 bp, Artificial Sequence
  Synthetic polynucleotide
aaaaagaacacatggtgcag

SEQ ID NO: 10087 - DNA, 21 bp, Artificial Sequence
  Synthetic polynucleotide
tccaagtctttgtgaagaact

SEQ ID NO: 10088 - DNA, 20 bp, Artificial Sequence
  Synthetic polynucleotide
ctgggctttctgttctgata

SEQ ID NO: 10089 - DNA, 20 bp, Artificial Sequence
  Synthetic polynucleotide
gtccaacagaatcagacagt

SEQ ID NO: 10090 - DNA, 20 bp, Artificial Sequence
  Synthetic polynucleotide
ggcttaaaggagtgtggtaa

SEQ ID NO: 10091 - DNA, 20 bp, Artificial Sequence
  Synthetic polynucleotide
gcaggcaacaatcttcttac

SEQ ID NO: 10092 - DNA, 20 bp, Artificial Sequence
  Synthetic polynucleotide
gccttaggcttcttaacctt

SEQ ID NO: 10093 - DNA, 20 bp, Artificial Sequence
  Synthetic polynucleotide
ccttacctcttgaattggct

SEQ ID NO: 10094 - DNA, 20 bp, Artificial Sequence
  Synthetic polynucleotide
ttctttcatcttctcgccaa

SEQ ID NO: 10095 - DNA, 20 bp, Artificial Sequence
  Synthetic polynucleotide
cagggtgtagctcatgaaat

SEQ ID NO: 10096 - DNA, 20 bp, Artificial Sequence
  Synthetic polynucleotide
agcacagcaatctagaaaca

SEQ ID NO: 10097 - DNA, 20 bp, Artificial Sequence
  Synthetic polynucleotide
tacaagtacgaagctacagc

SEQ ID NO: 10098 - DNA, 20 bp, Artificial Sequence
  Synthetic polynucleotide
cgagcttgtcatctatggaa

SEQ ID NO: 10099 - DNA, 20 bp, Artificial Sequence
  Synthetic polynucleotide
caagtcatggccaaatttgt

SEQ ID NO: 10100 - DNA, 20 bp, Artificial Sequence
  Synthetic polynucleotide
aagagcagaatcgttgaagt

SEQ ID NO: 10101 - DNA, 20 bp, Artificial Sequence
  Synthetic polynucleotide
atggtcagagacaaatcgag

SEQ ID NO: 10102 - DNA, 20 bp, Artificial Sequence
  Synthetic polynucleotide
aagcattagatttggagggg

SEQ ID NO: 10103 - DNA, 20 bp, Artificial Sequence
  Synthetic polynucleotide
cgttacatgcgagacaaaaa

SEQ ID NO: 10104 - DNA, 20 bp, Artificial Sequence
  Synthetic polynucleotide
gagctctgagaattgcagat

SEQ ID NO: 10105 - DNA, 20 bp, Artificial Sequence
  Synthetic polynucleotide
cttgatactctgaggaaggc

SEQ ID NO: 10106 - DNA, 20 bp, Artificial Sequence
  Synthetic polynucleotide
ccacccttcaaaactttcac

SEQ ID NO: 10107 - DNA, 20 bp, Artificial Sequence
  Synthetic polynucleotide
tcgaagaggaaaatgaccag

SEQ ID NO: 10108 - DNA, 20 bp, Artificial Sequence
  Synthetic polynucleotide
ctttggtgaggcgtaatact

SEQ ID NO: 10109 - DNA, 20 bp, Artificial Sequence
  Synthetic polynucleotide
atttgcagctatgggtgtta

SEQ ID NO: 10110 - DNA, 20 bp, Artificial Sequence
  Synthetic polynucleotide
gttctgttctcgtaggtacc

SEQ ID NO: 10111 - DNA, 20 bp, Artificial Sequence
  Synthetic polynucleotide
cagggtctcttggctatttt

SEQ ID NO: 10112 - DNA, 20 bp, Artificial Sequence
  Synthetic polynucleotide
gagaagttaggtgcctcaaa

SEQ ID NO: 10113 - DNA, 20 bp, Artificial Sequence
  Synthetic polynucleotide
gctgaaaaatggagaatgca

SEQ ID NO: 10114 - DNA, 20 bp, Artificial Sequence
  Synthetic polynucleotide
cacctctctttgtgaaggaa

SEQ ID NO: 10115 - DNA, 20 bp, Artificial Sequence
  Synthetic polynucleotide
tgtcaaacgccatttaactg

SEQ ID NO: 10116 - DNA, 20 bp, Artificial Sequence
  Synthetic polynucleotide
caatctggtccttccattca

SEQ ID NO: 10117 - DNA, 20 bp, Artificial Sequence
  Synthetic polynucleotide
ttatgctctaccgttatggc

SEQ ID NO: 10118 - DNA, 20 bp, Artificial Sequence
  Synthetic polynucleotide
gagaaggtagatagcagcac

SEQ ID NO: 10119 - DNA, 20 bp, Artificial Sequence
  Synthetic polynucleotide
tgaaaggaggtttgaacaca

SEQ ID NO: 10120 - DNA, 20 bp, Artificial Sequence
  Synthetic polynucleotide
taaatgtttccagcgacaga

SEQ ID NO: 10121 - DNA, 20 bp, Artificial Sequence
  Synthetic polynucleotide
aatggtatgttgcacatcca

SEQ ID NO: 10122 - DNA, 20 bp, Artificial Sequence
  Synthetic polynucleotide
tttcaggacgttctttttgc

SEQ ID NO: 10123 - DNA, 20 bp, Artificial Sequence
  Synthetic polynucleotide
aatcagaagcatcgaaaggt

SEQ ID NO: 10124 - DNA, 20 bp, Artificial Sequence
  Synthetic polynucleotide
tggagcagcaagaacattat

SEQ ID NO: 10125 - DNA, 20 bp, Artificial Sequence
  Synthetic polynucleotide
tgattcagaaacagaggcaa

SEQ ID NO: 10126 - DNA, 20 bp, Artificial Sequence
  Synthetic polynucleotide
ttgggatttgtttggtttgg

SEQ ID NO: 10127 - DNA, 20 bp, Artificial Sequence
  Synthetic polynucleotide
ccgatgaagagccataatga

SEQ ID NO: 10128 - DNA, 20 bp, Artificial Sequence
  Synthetic polynucleotide
ccttcccaacgtctctttaa

SEQ ID NO: 10129 - DNA, 20 bp, Artificial Sequence
  Synthetic polynucleotide
taatgtggtcacaacgtgat

SEQ ID NO: 10130 - DNA, 20 bp, Artificial Sequence
  Synthetic polynucleotide
ttactacgcccttcctctaa

SEQ ID NO: 10131 - DNA, 20 bp, Artificial Sequence
  Synthetic polynucleotide
ttgtgaagatgctaaccctc

SEQ ID NO: 10132 - DNA, 20 bp, Artificial Sequence
  Synthetic polynucleotide
attcggaaagaacttgagct

SEQ ID NO: 10133 - DNA, 20 bp, Artificial Sequence
  Synthetic polynucleotide
aaagattggtcctcttggtc

SEQ ID NO: 10134 - DNA, 20 bp, Artificial Sequence
  Synthetic polynucleotide
cggaaggagttttaccatca

SEQ ID NO: 10135 - DNA, 20 bp, Artificial Sequence
  Synthetic polynucleotide
agctggagtaactgaagttg

SEQ ID NO: 10136 - DNA, 20 bp, Artificial Sequence
  Synthetic polynucleotide
attcgagcagtaggatgaac

SEQ ID NO: 10137 - DNA, 20 bp, Artificial Sequence
  Synthetic polynucleotide
tatattacattcgccaccgg

SEQ ID NO: 10138 - DNA, 20 bp, Artificial Sequence
  Synthetic polynucleotide
tatcgcttgttggtactctg

SEQ ID NO: 10139 - DNA, 20 bp, Artificial Sequence
  Synthetic polynucleotide
caggattggacaattgggta

SEQ ID NO: 10140 - DNA, 20 bp, Artificial Sequence
  Synthetic polynucleotide
ccttccaaacgtattttccg

SEQ ID NO: 10141 - DNA, 20 bp, Artificial Sequence
  Synthetic polynucleotide
aagctctgttggaattgagt

SEQ ID NO: 10142 - DNA, 20 bp, Artificial Sequence
  Synthetic polynucleotide
ttgcttccttcttctcttcg

SEQ ID NO: 10143 - DNA, 20 bp, Artificial Sequence
  Synthetic polynucleotide
agggcccagtaaaaagaaaa

SEQ ID NO: 10144 - DNA, 20 bp, Artificial Sequence
  Synthetic polynucleotide
ccaaaggttccatcaccata

SEQ ID NO: 10145 - DNA, 20 bp, Artificial Sequence
  Synthetic polynucleotide
tggcttatcatcaatcggag

SEQ ID NO: 10146 - DNA, 20 bp, Artificial Sequence
  Synthetic polynucleotide
tgagcatttaaaattcgccc

SEQ ID NO: 10147 - DNA, 21 bp, Artificial Sequence
  Synthetic polynucleotide
gctggtaaaacaactcttctc

SEQ ID NO: 10148 - DNA, 21 bp, Artificial Sequence
  Synthetic polynucleotide
actgaacacatgaatagctct

SEQ ID NO: 10149 - DNA, 20 bp, Artificial Sequence
  Synthetic polynucleotide
aaatcatactgctgccttca

SEQ ID NO: 10150 - DNA, 20 bp, Artificial Sequence
  Synthetic polynucleotide
agagggcttctgatgactat

SEQ ID NO: 10151 - DNA, 20 bp, Artificial Sequence
  Synthetic polynucleotide
cagaattagtttgccgtgtc

SEQ ID NO: 10152 - DNA, 20 bp, Artificial Sequence
  Synthetic polynucleotide
catcacacccctgatcatag

SEQ ID NO: 10153 - DNA, 20 bp, Artificial Sequence
  Synthetic polynucleotide
aggcaaagttggactatctg

SEQ ID NO: 10154 - DNA, 20 bp, Artificial Sequence
  Synthetic polynucleotide
cgcttccgccatataatcta

SEQ ID NO: 10155 - DNA, 20 bp, Artificial Sequence
  Synthetic polynucleotide
tcaaacgaaacaggatagca

SEQ ID NO: 10156 - DNA, 20 bp, Artificial Sequence
  Synthetic polynucleotide
atgaggactactaggtgcat

SEQ ID NO: 10157 - DNA, 23 bp, Artificial Sequence
  Synthetic polynucleotide
ggaaagattttgattgaatcagc

SEQ ID NO: 10158 - DNA, 20 bp, Artificial Sequence
  Synthetic polynucleotide
gattatggacagcttgtgga

SEQ ID NO: 10159 - DNA, 20 bp, Artificial Sequence
  Synthetic polynucleotide
ttggcatccggataaaagaa

SEQ ID NO: 10160 - DNA, 20 bp, Artificial Sequence
  Synthetic polynucleotide
tgtcaaagcatcatcagaca

SEQ ID NO: 10161 - DNA, 20 bp, Artificial Sequence
  Synthetic polynucleotide
ctcattgtttagcctccagt

SEQ ID NO: 10162 - DNA, 20 bp, Artificial Sequence
  Synthetic polynucleotide
tttctgatgccaactaagct

SEQ ID NO: 10163 - DNA, 20 bp, Artificial Sequence
  Synthetic polynucleotide
gtgatggctgctatacgtaa

SEQ ID NO: 10164 - DNA, 20 bp, Artificial Sequence
  Synthetic polynucleotide
aacacttgtctaaccccatc

SEQ ID NO: 10165 - DNA, 20 bp, Artificial Sequence
  Synthetic polynucleotide
ttttggagttgtgggtgtta

SEQ ID NO: 10166 - DNA, 20 bp, Artificial Sequence
  Synthetic polynucleotide
tgatgcattatgctttgctg

SEQ ID NO: 10167 - DNA, 20 bp, Artificial Sequence
  Synthetic polynucleotide
gagctttccatccttcaaga

SEQ ID NO: 10168 - DNA, 20 bp, Artificial Sequence
  Synthetic polynucleotide
acaacatctgatccagcatt

SEQ ID NO: 10169 - DNA, 20 bp, Artificial Sequence
  Synthetic polynucleotide
gttggttgcaccttctagta

SEQ ID NO: 10170 - DNA, 20 bp, Artificial Sequence
  Synthetic polynucleotide
gttgataagaactgcagtgc

SEQ ID NO: 10171 - DNA, 21 bp, Artificial Sequence
  Synthetic polynucleotide
gaatccgtttcaattcgaact

SEQ ID NO: 10172 - DNA, 20 bp, Artificial Sequence
  Synthetic polynucleotide
cattttctgtcgtttgctgt

SEQ ID NO: 10173 - DNA, 20 bp, Artificial Sequence
  Synthetic polynucleotide
ctttgcaaatgccaccttta

SEQ ID NO: 10174 - DNA, 20 bp, Artificial Sequence
  Synthetic polynucleotide
acctgtgagtacgacttttc

SEQ ID NO: 10175 - DNA, 20 bp, Artificial Sequence
  Synthetic polynucleotide
taaaacaagctgttaggggc

SEQ ID NO: 10176 - DNA, 20 bp, Artificial Sequence
  Synthetic polynucleotide
cccttgtgctttagagagtt

SEQ ID NO: 10177 - DNA, 20 bp, Artificial Sequence
  Synthetic polynucleotide
ttggctgctgaaaagaaaag

SEQ ID NO: 10178 - DNA, 20 bp, Artificial Sequence
  Synthetic polynucleotide
ctcatcagaggttggaagtc

SEQ ID NO: 10179 - DNA, 20 bp, Artificial Sequence
  Synthetic polynucleotide
tttgaacagcaaaaagaccc

SEQ ID NO: 10180 - DNA, 20 bp, Artificial Sequence
  Synthetic polynucleotide
cgtgttttcaacttcggaat

SEQ ID NO: 10181 - DNA, 20 bp, Artificial Sequence
  Synthetic polynucleotide
atgctctagaccatcttcct

SEQ ID NO: 10182 - DNA, 20 bp, Artificial Sequence
  Synthetic polynucleotide
tgctctatctgtgtcaccta

SEQ ID NO: 10183 - DNA, 20 bp, Artificial Sequence
  Synthetic polynucleotide
tttctccagctactgtcaac

SEQ ID NO: 10184 - DNA, 20 bp, Artificial Sequence
  Synthetic polynucleotide
tgtacctgttcagttcatgg

SEQ ID NO: 10185 - DNA, 20 bp, Artificial Sequence
  Synthetic polynucleotide
aaatgaatctcctgaaggcg

SEQ ID NO: 10186 - DNA, 20 bp, Artificial Sequence
  Synthetic polynucleotide
tcacttttccataaccacct

SEQ ID NO: 10187 - DNA, 20 bp, Artificial Sequence
  Synthetic polynucleotide
cctacagataggcagctttt

SEQ ID NO: 10188 - DNA, 20 bp, Artificial Sequence
  Synthetic polynucleotide
gctaattgactttgagtggc

SEQ ID NO: 10189 - DNA, 20 bp, Artificial Sequence
  Synthetic polynucleotide
gttatgttgaagcagctcac

SEQ ID NO: 10190 - DNA, 20 bp, Artificial Sequence
  Synthetic polynucleotide
cgtaagcagctgataggaat

SEQ ID NO: 10191 - DNA, 20 bp, Artificial Sequence
  Synthetic polynucleotide
agcaagaggttcagaaagtt

SEQ ID NO: 10192 - DNA, 20 bp, Artificial Sequence
  Synthetic polynucleotide
ccagtgcctcttgatttctt

SEQ ID NO: 10193 - DNA, 20 bp, Artificial Sequence
  Synthetic polynucleotide
aagctggatgaagttgacaa

SEQ ID NO: 10194 - DNA, 20 bp, Artificial Sequence
  Synthetic polynucleotide
tatggaagggatctggcata

SEQ ID NO: 10195 - DNA, 20 bp, Artificial Sequence
  Synthetic polynucleotide
gtcacacattcttcagcatg

SEQ ID NO: 10196 - DNA, 20 bp, Artificial Sequence
  Synthetic polynucleotide
ttccccatttctacagcttc

SEQ ID NO: 10197 - DNA, 20 bp, Artificial Sequence
  Synthetic polynucleotide
taaaacctctgcttgacctc

SEQ ID NO: 10198 - DNA, 20 bp, Artificial Sequence
  Synthetic polynucleotide
agcgaaatgtgctgtatttg

SEQ ID NO: 10199 - DNA, 20 bp, Artificial Sequence
  Synthetic polynucleotide
cgagaacatttattggcaca

SEQ ID NO: 10200 - DNA, 18 bp, Artificial Sequence
  Synthetic polynucleotide
gagcacccatttgaggag

SEQ ID NO: 10201 - DNA, 20 bp, Artificial Sequence
  Synthetic polynucleotide
cccaccaatttaggatcaca

SEQ ID NO: 10202 - DNA, 20 bp, Artificial Sequence
  Synthetic polynucleotide
gacagtcattctcctctgtc

SEQ ID NO: 10203 - DNA, 20 bp, Artificial Sequence
  Synthetic polynucleotide
gatcaggatagcagatgcaa

SEQ ID NO: 10204 - DNA, 20 bp, Artificial Sequence
  Synthetic polynucleotide
tcctcctcttcaccgattat

SEQ ID NO: 10205 - DNA, 20 bp, Artificial Sequence
  Synthetic polynucleotide
gttggtcctgttctctcatt

SEQ ID NO: 10206 - DNA, 20 bp, Artificial Sequence
  Synthetic polynucleotide
catatccagatcaccacctg

SEQ ID NO: 10207 - DNA, 20 bp, Artificial Sequence
  Synthetic polynucleotide
tggtcagattgttggagaag

SEQ ID NO: 10208 - DNA, 20 bp, Artificial Sequence
  Synthetic polynucleotide
gccatgatcattttcacctg

SEQ ID NO: 10209 - DNA, 21 bp, Artificial Sequence
  Synthetic polynucleotide
ccaggttgaatatgctatgga

SEQ ID NO: 10210 - DNA, 20 bp, Artificial Sequence
  Synthetic polynucleotide
tcttgaacttgatcaggtgg

SEQ ID NO: 10211 - DNA, 20 bp, Artificial Sequence
  Synthetic polynucleotide
agaaaatcactggaccagac

SEQ ID NO: 10212 - DNA, 20 bp, Artificial Sequence
  Synthetic polynucleotide
tctgccaaatcatcactcaa

SEQ ID NO: 10213 - DNA, 20 bp, Artificial Sequence
  Synthetic polynucleotide
ctacatcaaggctgagactc

SEQ ID NO: 10214 - DNA, 20 bp, Artificial Sequence
  Synthetic polynucleotide
cattgtatagccactgtcga

SEQ ID NO: 10215 - DNA, 20 bp, Artificial Sequence
  Synthetic polynucleotide
cttggtgacagagctctatc

SEQ ID NO: 10216 - DNA, 20 bp, Artificial Sequence
  Synthetic polynucleotide
gtgttcagcaaaatgttcca

SEQ ID NO: 10217 - DNA, 20 bp, Artificial Sequence
  Synthetic polynucleotide
gtgttgctattgcttctgac

SEQ ID NO: 10218 - DNA, 20 bp, Artificial Sequence
  Synthetic polynucleotide
tatgaaaacagaagctcccc

SEQ ID NO: 10219 - DNA, 20 bp, Artificial Sequence
  Synthetic polynucleotide
gctgcacaaactatgagaac

SEQ ID NO: 10220 - DNA, 20 bp, Artificial Sequence
  Synthetic polynucleotide
tgggcgacagaaatatgaaa

SEQ ID NO: 10221 - DNA, 20 bp, Artificial Sequence
  Synthetic polynucleotide
aagcttacatggaccttctg

SEQ ID NO: 10222 - DNA, 20 bp, Artificial Sequence
  Synthetic polynucleotide
catcgatgtcataacaagcg

SEQ ID NO: 10223 - DNA, 20 bp, Artificial Sequence
  Synthetic polynucleotide
gaaccgactcttgaggaatt

SEQ ID NO: 10224 - DNA, 20 bp, Artificial Sequence
  Synthetic polynucleotide
tgcaactcgttccaaaattc

SEQ ID NO: 10225 - DNA, 20 bp, Artificial Sequence
  Synthetic polynucleotide
cgtgatgtatgggctcataa

SEQ ID NO: 10226 - DNA, 20 bp, Artificial Sequence
  Synthetic polynucleotide
caagtgaccacagtatttgc

SEQ ID NO: 10227 - DNA, 20 bp, Artificial Sequence
  Synthetic polynucleotide
atggccaacatgttgtatct

SEQ ID NO: 10228 - DNA, 20 bp, Artificial Sequence
  Synthetic polynucleotide
gatgtcatcactcttcacga

SEQ ID NO: 10229 - DNA, 20 bp, Artificial Sequence
  Synthetic polynucleotide
ttttgtatttccccacccaa

SEQ ID NO: 10230 - DNA, 20 bp, Artificial Sequence
  Synthetic polynucleotide
aacgtgcttattcctcagtt

SEQ ID NO: 10231 - DNA, 20 bp, Artificial Sequence
  Synthetic polynucleotide
atactggaatcgttggtagc

SEQ ID NO: 10232 - DNA, 20 bp, Artificial Sequence
  Synthetic polynucleotide
gttcatcttggcagtgattg

SEQ ID NO: 10233 - DNA, 21 bp, Artificial Sequence
  Synthetic polynucleotide
gtggaaattgcaaaatgttca

SEQ ID NO: 10234 - DNA, 20 bp, Artificial Sequence
  Synthetic polynucleotide
gtacttgttcctcttcagca

SEQ ID NO: 10235 - DNA, 20 bp, Artificial Sequence
  Synthetic polynucleotide
aatgtcctgtcacagtttgt

SEQ ID NO: 10236 - DNA, 20 bp, Artificial Sequence
  Synthetic polynucleotide
tccattatggctgcttgatt

SEQ ID NO: 10237 - DNA, 20 bp, Artificial Sequence
  Synthetic polynucleotide
ataaccctggaagttgaacc

SEQ ID NO: 10238 - DNA, 20 bp, Artificial Sequence
  Synthetic polynucleotide
tgctgattttaccgttctca

SEQ ID NO: 10239 - DNA, 20 bp, Artificial Sequence
  Synthetic polynucleotide
tcggagatggtactacaagt

SEQ ID NO: 10240 - DNA, 20 bp, Artificial Sequence
  Synthetic polynucleotide
catgtctttggtagtggtga

SEQ ID NO: 10241 - DNA, 20 bp, Artificial Sequence
  Synthetic polynucleotide
gctgttgagaaaaatctcgg

SEQ ID NO: 10242 - DNA, 20 bp, Artificial Sequence
  Synthetic polynucleotide
aaaaggccaccaaatttagc

SEQ ID NO: 10243 - DNA, 20 bp, Artificial Sequence
  Synthetic polynucleotide
ggaaacgttgtacttaccct

SEQ ID NO: 10244 - DNA, 20 bp, Artificial Sequence
  Synthetic polynucleotide
cttggtagtgaagacaagct

SEQ ID NO: 10245 - DNA, 20 bp, Artificial Sequence
  Synthetic polynucleotide
aagcttaaccaaggagaagg

SEQ ID NO: 10246 - DNA, 20 bp, Artificial Sequence
  Synthetic polynucleotide
tgagctctgataatgcatcc

SEQ ID NO: 10247 - DNA, 20 bp, Artificial Sequence
  Synthetic polynucleotide
gaaaatgtggacttagctgc

SEQ ID NO: 10248 - DNA, 20 bp, Artificial Sequence
  Synthetic polynucleotide
actggcaagtactactttgg

SEQ ID NO: 10249 - DNA, 20 bp, Artificial Sequence
  Synthetic polynucleotide
cttcacgaaacttcttgagc

SEQ ID NO: 10250 - DNA, 20 bp, Artificial Sequence
  Synthetic polynucleotide
tctgcttagggttatagcct

SEQ ID NO: 10251 - DNA, 20 bp, Artificial Sequence
  Synthetic polynucleotide
tagttttgcagtgccatttg

SEQ ID NO: 10252 - DNA, 20 bp, Artificial Sequence
  Synthetic polynucleotide
tcagcatcacgattactgag

SEQ ID NO: 10253 - DNA, 20 bp, Artificial Sequence
  Synthetic polynucleotide
gcagaaaccaaatgttgtca

SEQ ID NO: 10254 - DNA, 20 bp, Artificial Sequence
  Synthetic polynucleotide
tattcttcgcaccagaaaca

SEQ ID NO: 10255 - DNA, 20 bp, Artificial Sequence
  Synthetic polynucleotide
aaacgttggtcattctttgg

SEQ ID NO: 10256 - DNA, 21 bp, Artificial Sequence
  Synthetic polynucleotide
atctctttcagcagctgatat

SEQ ID NO: 10257 - DNA, 20 bp, Artificial Sequence
  Synthetic polynucleotide
agctgcataactcaaagaca

SEQ ID NO: 10258 - DNA, 20 bp, Artificial Sequence
  Synthetic polynucleotide
cttcatcatctttctgggct

SEQ ID NO: 10259 - DNA, 20 bp, Artificial Sequence
  Synthetic polynucleotide
aggtttggataagctccttg

SEQ ID NO: 10260 - DNA, 20 bp, Artificial Sequence
  Synthetic polynucleotide
tcgaatccccattgacaaat

SEQ ID NO: 10261 - DNA, 22 bp, Artificial Sequence
  Synthetic polynucleotide
cagtagtggaaaaggtgaaaaa

SEQ ID NO: 10262 - DNA, 20 bp, Artificial Sequence
  Synthetic polynucleotide
cctagtcttcaaccatctcg

SEQ ID NO: 10263 - DNA, 20 bp, Artificial Sequence
  Synthetic polynucleotide
tttaagcgcgatacagatca

SEQ ID NO: 10264 - DNA, 20 bp, Artificial Sequence
  Synthetic polynucleotide
gcaaaggattccatagcaac

SEQ ID NO: 10265 - DNA, 20 bp, Artificial Sequence
  Synthetic polynucleotide
agcaacagttggtgtaaaga

SEQ ID NO: 10266 - DNA, 20 bp, Artificial Sequence
  Synthetic polynucleotide
atcactagctccacctgtat

SEQ ID NO: 10267 - DNA, 20 bp, Artificial Sequence
  Synthetic polynucleotide
agattaaaggacggtgcatt

SEQ ID NO: 10268 - DNA, 20 bp, Artificial Sequence
  Synthetic polynucleotide
gtacgcatcaaaaacctgag

SEQ ID NO: 10269 - DNA, 20 bp, Artificial Sequence
  Synthetic polynucleotide
acagagtaacacaacagcat

SEQ ID NO: 10270 - DNA, 20 bp, Artificial Sequence
  Synthetic polynucleotide
gaggaggagctttgtttgta

SEQ ID NO: 10271 - DNA, 20 bp, Artificial Sequence
  Synthetic polynucleotide
ccacacaaaacaccgtaaag

SEQ ID NO: 10272 - DNA, 20 bp, Artificial Sequence
  Synthetic polynucleotide
aagttcctctcttgacagtg

SEQ ID NO: 10273 - DNA, 18 bp, Artificial Sequence
  Synthetic polynucleotide
caaagctgccaggaagag

SEQ ID NO: 10274 - DNA, 20 bp, Artificial Sequence
  Synthetic polynucleotide
cacaagttggtatcctcgaa

SEQ ID NO: 10275 - DNA, 20 bp, Artificial Sequence
  Synthetic polynucleotide
attatgacaatgcaaagccg

SEQ ID NO: 10276 - DNA, 20 bp, Artificial Sequence
  Synthetic polynucleotide
ctttagtggtctcagcaact

SEQ ID NO: 10277 - DNA, 20 bp, Artificial Sequence
  Synthetic polynucleotide
agatcaacttcatgtggcat

SEQ ID NO: 10278 - DNA, 20 bp, Artificial Sequence
  Synthetic polynucleotide
tcagggccaactctattttc

SEQ ID NO: 10279 - DNA, 20 bp, Artificial Sequence
  Synthetic polynucleotide
tctgaagtccaacatgagtg

SEQ ID NO: 10280 - DNA, 20 bp, Artificial Sequence
  Synthetic polynucleotide
cttggcaagtctctcttctt

SEQ ID NO: 10281 - DNA, 20 bp, Artificial Sequence
  Synthetic polynucleotide
aaatacgagggtttctgcat

SEQ ID NO: 10282 - DNA, 20 bp, Artificial Sequence
  Synthetic polynucleotide
gcatataaccatgctcagga

SEQ ID NO: 10283 - DNA, 20 bp, Artificial Sequence
  Synthetic polynucleotide
agtgctagaggtcctacatt

SEQ ID NO: 10284 - DNA, 20 bp, Artificial Sequence
  Synthetic polynucleotide
cccaagaggatgaacatcaa

SEQ ID NO: 10285 - DNA, 20 bp, Artificial Sequence
  Synthetic polynucleotide
tatgaattaggacgaccagc

SEQ ID NO: 10286 - DNA, 20 bp, Artificial Sequence
  Synthetic polynucleotide
cccctcgaggatataaccat

SEQ ID NO: 10287 - DNA, 20 bp, Artificial Sequence
  Synthetic polynucleotide
gacacagcagaacaagtcta

SEQ ID NO: 10288 - DNA, 20 bp, Artificial Sequence
  Synthetic polynucleotide
aaatgcctcttagggtcttg

SEQ ID NO: 10289 - DNA, 20 bp, Artificial Sequence
  Synthetic polynucleotide
attctggagcaaatggatgt

SEQ ID NO: 10290 - DNA, 20 bp, Artificial Sequence
  Synthetic polynucleotide
tttctgtaccagctcagaac

SEQ ID NO: 10291 - DNA, 22 bp, Artificial Sequence
  Synthetic polynucleotide
tggttgaaaacagcttatgatg

SEQ ID NO: 10292 - DNA, 20 bp, Artificial Sequence
  Synthetic polynucleotide
atctaatttctcgccacgtt

SEQ ID NO: 10293 - DNA, 20 bp, Artificial Sequence
  Synthetic polynucleotide
gttaggttccacggctatag

SEQ ID NO: 10294 - DNA, 20 bp, Artificial Sequence
  Synthetic polynucleotide
tggtatacatgcgaaactgt

SEQ ID NO: 10295 - DNA, 20 bp, Artificial Sequence
  Synthetic polynucleotide
agcagccttcaaaatatgga

SEQ ID NO: 10296 - DNA, 20 bp, Artificial Sequence
  Synthetic polynucleotide
ctaaaccaggaatgtccaca

SEQ ID NO: 10297 - DNA, 20 bp, Artificial Sequence
  Synthetic polynucleotide
gccatcaacatccttaaagc

SEQ ID NO: 10298 - DNA, 20 bp, Artificial Sequence
  Synthetic polynucleotide
ttcccgtgaacttaaggaag

SEQ ID NO: 10299 - DNA, 23 bp, Artificial Sequence
  Synthetic polynucleotide
aataacacacttgatgatcatca

SEQ ID NO: 10300 - DNA, 20 bp, Artificial Sequence
  Synthetic polynucleotide
gtgactgttgcaatttggaa

SEQ ID NO: 10301 - DNA, 20 bp, Artificial Sequence
  Synthetic polynucleotide
atacagctcttcatcgaacc

SEQ ID NO: 10302 - DNA, 20 bp, Artificial Sequence
  Synthetic polynucleotide
gcttcactcgtttactttgg

SEQ ID NO: 10303 - DNA, 20 bp, Artificial Sequence
  Synthetic polynucleotide
ttgttgatccaggattcgtt

SEQ ID NO: 10304 - DNA, 20 bp, Artificial Sequence
  Synthetic polynucleotide
tttcctaacatcttgggctc

SEQ ID NO: 10305 - DNA, 20 bp, Artificial Sequence
  Synthetic polynucleotide
tcctaacctcaggcatagaa

SEQ ID NO: 10306 - DNA, 20 bp, Artificial Sequence
  Synthetic polynucleotide
tctatagcaccccatgaaga

SEQ ID NO: 10307 - DNA, 20 bp, Artificial Sequence
  Synthetic polynucleotide
agatgaacacaggactttcc

SEQ ID NO: 10308 - DNA, 20 bp, Artificial Sequence
  Synthetic polynucleotide
tgccgttgaacttcttatca

SEQ ID NO: 10309 - DNA, 20 bp, Artificial Sequence
  Synthetic polynucleotide
agcagttattggaaactcgt

SEQ ID NO: 10310 - DNA, 20 bp, Artificial Sequence
  Synthetic polynucleotide
ctgagattgcaacatcacac

SEQ ID NO: 10311 - DNA, 20 bp, Artificial Sequence
  Synthetic polynucleotide
aaacagtggttgaagttcct

SEQ ID NO: 10312 - DNA, 20 bp, Artificial Sequence
  Synthetic polynucleotide
atcatccatctccattcgtg

SEQ ID NO: 10313 - DNA, 22 bp, Artificial Sequence
  Synthetic polynucleotide
gttccaagtctatgtgaagaac

SEQ ID NO: 10314 - DNA, 20 bp, Artificial Sequence
  Synthetic polynucleotide
tgtgctttctgttccgataa

SEQ ID NO: 10315 - DNA, 20 bp, Artificial Sequence
  Synthetic polynucleotide
agaaacctatggatctcgga

SEQ ID NO: 10316 - DNA, 20 bp, Artificial Sequence
  Synthetic polynucleotide
tgcattatcctcatcttccg

SEQ ID NO: 10317 - DNA, 20 bp, Artificial Sequence
  Synthetic polynucleotide
tgaatcaaaagaggtacgca

SEQ ID NO: 10318 - DNA, 20 bp, Artificial Sequence
  Synthetic polynucleotide
agctttcctcttcagaactg

SEQ ID NO: 10319 - DNA, 20 bp, Artificial Sequence
  Synthetic polynucleotide
atggtgaccctattgaaacc

SEQ ID NO: 10320 - DNA, 20 bp, Artificial Sequence
  Synthetic polynucleotide
gcacatgacctcaaaacaaa

SEQ ID NO: 10321 - DNA, 20 bp, Artificial Sequence
  Synthetic polynucleotide
taacattggtgtcgttgcta

SEQ ID NO: 10322 - DNA, 20 bp, Artificial Sequence
  Synthetic polynucleotide
tcagagccactatcttcaga

SEQ ID NO: 10323 - DNA, 20 bp, Artificial Sequence
  Synthetic polynucleotide
aagaggtagagtggagagtc

SEQ ID NO: 10324 - DNA, 20 bp, Artificial Sequence
  Synthetic polynucleotide
gaagaagaggagaaactgca

SEQ ID NO: 10325 - DNA, 20 bp, Artificial Sequence
  Synthetic polynucleotide
gactgaactatctgccgaat

SEQ ID NO: 10326 - DNA, 20 bp, Artificial Sequence
  Synthetic polynucleotide
tgtccagtttctgttccaaa

SEQ ID NO: 10327 - DNA, 20 bp, Artificial Sequence
  Synthetic polynucleotide
gcaactagctctcgaaacta

SEQ ID NO: 10328 - DNA, 20 bp, Artificial Sequence
  Synthetic polynucleotide
aagcattagatttggagggg

SEQ ID NO: 10329 - DNA, 20 bp, Artificial Sequence
  Synthetic polynucleotide
tgtgaaaccaaaactggaga

SEQ ID NO: 10330 - DNA, 20 bp, Artificial Sequence
  Synthetic polynucleotide
cacctcctcttgattgtgaa

SEQ ID NO: 10331 - DNA, 20 bp, Artificial Sequence
  Synthetic polynucleotide
gagtgggcttggaaattcta

SEQ ID NO: 10332 - DNA, 20 bp, Artificial Sequence
  Synthetic polynucleotide
gaagaaactttttcggccaa

SEQ ID NO: 10333 - DNA, 20 bp, Artificial Sequence
  Synthetic polynucleotide
aggaaaatgaccagatgacg

SEQ ID NO: 10334 - DNA, 20 bp, Artificial Sequence
  Synthetic polynucleotide
aattgtgactccctttggtc

SEQ ID NO: 10335 - DNA, 20 bp, Artificial Sequence
  Synthetic polynucleotide
tgaagatatgcttggacgag

SEQ ID NO: 10336 - DNA, 20 bp, Artificial Sequence
  Synthetic polynucleotide
catcgttaggcatggtaaga

SEQ ID NO: 10337 - DNA, 20 bp, Artificial Sequence
  Synthetic polynucleotide
gtcaaagaccagacactcat

SEQ ID NO: 10338 - DNA, 20 bp, Artificial Sequence
  Synthetic polynucleotide
tgatgaagaaggaggttgtg

SEQ ID NO: 10339 - DNA, 20 bp, Artificial Sequence
  Synthetic polynucleotide
gcacaattaggagaaggtga

SEQ ID NO: 10340 - DNA, 20 bp, Artificial Sequence
  Synthetic polynucleotide
gtacccttccagtaacttgg

SEQ ID NO: 10341 - DNA, 20 bp, Artificial Sequence
  Synthetic polynucleotide
tgtcaaacgccatttaactg

SEQ ID NO: 10342 - DNA, 20 bp, Artificial Sequence
  Synthetic polynucleotide
attcaggatccatgttgacc

SEQ ID NO: 10343 - DNA, 20 bp, Artificial Sequence
  Synthetic polynucleotide
tcattttgatgctttaccgc

SEQ ID NO: 10344 - DNA, 20 bp, Artificial Sequence
  Synthetic polynucleotide
ataaatagctgcacagacga

SEQ ID NO: 10345 - DNA, 20 bp, Artificial Sequence
  Synthetic polynucleotide
cagcctaagaacgattacga

SEQ ID NO: 10346 - DNA, 20 bp, Artificial Sequence
  Synthetic polynucleotide
tttttcgttccattttcgca

SEQ ID NO: 10347 - DNA, 20 bp, Artificial Sequence
  Synthetic polynucleotide
aatggtatgttgcacatcca

SEQ ID NO: 10348 - DNA, 20 bp, Artificial Sequence
  Synthetic polynucleotide
gctttcaggacgttcttttt

SEQ ID NO: 10349 - DNA, 20 bp, Artificial Sequence
  Synthetic polynucleotide
aaactggaatccatgctcat

SEQ ID NO: 10350 - DNA, 20 bp, Artificial Sequence
  Synthetic polynucleotide
tgtttggatcaccttcaaca

SEQ ID NO: 10351 - DNA, 20 bp, Artificial Sequence
  Synthetic polynucleotide
tcagatactgaggctcttca

SEQ ID NO: 10352 - DNA, 20 bp, Artificial Sequence
  Synthetic polynucleotide
ttctttccaccatgaccaaa

SEQ ID NO: 10353 - DNA, 20 bp, Artificial Sequence
  Synthetic polynucleotide
ggaggagtagagacagaagt

SEQ ID NO: 10354 - DNA, 20 bp, Artificial Sequence
  Synthetic polynucleotide
acatctgcttgatttcccat

SEQ ID NO: 10355 - DNA, 20 bp, Artificial Sequence
  Synthetic polynucleotide
atcgttggaactaagccttt

SEQ ID NO: 10356 - DNA, 20 bp, Artificial Sequence
  Synthetic polynucleotide
gaagagtctttctccaagca

SEQ ID NO: 10357 - DNA, 20 bp, Artificial Sequence
  Synthetic polynucleotide
caggttcaacttcagctact

SEQ ID NO: 10358 - DNA, 20 bp, Artificial Sequence
  Synthetic polynucleotide
agtcacaccaaaactgttct

SEQ ID NO: 10359 - DNA, 20 bp, Artificial Sequence
  Synthetic polynucleotide
ctacatcttctcttgctccc

SEQ ID NO: 10360 - DNA, 20 bp, Artificial Sequence
  Synthetic polynucleotide
accaacagactgacatgtac

SEQ ID NO: 10361 - DNA, 20 bp, Artificial Sequence
  Synthetic polynucleotide
ctagacttagacccctgaca

SEQ ID NO: 10362 - DNA, 20 bp, Artificial Sequence
  Synthetic polynucleotide
gctttctgacgtagagatgt

SEQ ID NO: 10363 - DNA, 20 bp, Artificial Sequence
  Synthetic polynucleotide
tatattacattcgccaccgg

SEQ ID NO: 10364 - DNA, 20 bp, Artificial Sequence
  Synthetic polynucleotide
gtgtctgacatcgtatggta

SEQ ID NO: 10365 - DNA, 20 bp, Artificial Sequence
  Synthetic polynucleotide
aaggagagtttgtgctactg

SEQ ID NO: 10366 - DNA, 20 bp, Artificial Sequence
  Synthetic polynucleotide
tgccaaggcttgttgtatat

SEQ ID NO: 10367 - DNA, 20 bp, Artificial Sequence
  Synthetic polynucleotide
tcagcagctgatattgacaa

SEQ ID NO: 10368 - DNA, 20 bp, Artificial Sequence
  Synthetic polynucleotide
tcttttcctcagctgcttta

SEQ ID NO: 10369 - DNA, 20 bp, Artificial Sequence
  Synthetic polynucleotide
taggcctaaatcgaaagtcg

SEQ ID NO: 10370 - DNA, 20 bp, Artificial Sequence
  Synthetic polynucleotide
gcaatcttctgcttgtcttc

SEQ ID NO: 10371 - DNA, 20 bp, Artificial Sequence
  Synthetic polynucleotide
gcctctatgccattaggtac

SEQ ID NO: 10372 - DNA, 20 bp, Artificial Sequence
  Synthetic polynucleotide
aaaattcgccctacctgaat

SEQ ID NO: 10373 - DNA, 21 bp, Artificial Sequence
  Synthetic polynucleotide
aggcaaactgttgtttttagg

SEQ ID NO: 10374 - DNA, 20 bp, Artificial Sequence
  Synthetic polynucleotide
gacaattcacttcgtggaac

SEQ ID NO: 10375 - DNA, 20 bp, Artificial Sequence
  Synthetic polynucleotide
aaatcatactgctgccttca

SEQ ID NO: 10376 - DNA, 20 bp, Artificial Sequence
  Synthetic polynucleotide
accaggtttgcgaagaatat

SEQ ID NO: 10377 - DNA, 20 bp, Artificial Sequence
  Synthetic polynucleotide
ttctaaaaggtccaggcatc

SEQ ID NO: 10378 - DNA, 20 bp, Artificial Sequence
  Synthetic polynucleotide
tcttccactggatgttgaag

SEQ ID NO: 10379 - DNA, 20 bp, Artificial Sequence
  Synthetic polynucleotide
ggtgggtaatggatgaaagt

SEQ ID NO: 10380 - DNA, 20 bp, Artificial Sequence
  Synthetic polynucleotide
gtaatggggatgtagcagag

SEQ ID NO: 10381 - DNA, 20 bp, Artificial Sequence
  Synthetic polynucleotide
ctatacctgtcgaccaaagg

SEQ ID NO: 10382 - DNA, 20 bp, Artificial Sequence
  Synthetic polynucleotide
ttctcttgctcccttttctc

SEQ ID NO: 10383 - DNA, 20 bp, Artificial Sequence
  Synthetic polynucleotide
ttgaaagtcgaaggcatgta

SEQ ID NO: 10384 - DNA, 20 bp, Artificial Sequence
  Synthetic polynucleotide
ggtgactgttagcaaggtaa

SEQ ID NO: 10385 - DNA, 20 bp, Artificial Sequence
  Synthetic polynucleotide
tgaaggtgaggttgttgaaa

SEQ ID NO: 10386 - DNA, 20 bp, Artificial Sequence
  Synthetic polynucleotide
ccgaagacttgtctccatag

SEQ ID NO: 10387 - DNA, 20 bp, Artificial Sequence
  Synthetic polynucleotide
tttacggatgtttcgtggat

SEQ ID NO: 10388 - DNA, 20 bp, Artificial Sequence
  Synthetic polynucleotide
tcctaatccaagttctgcac

SEQ ID NO: 10389 - DNA, 20 bp, Artificial Sequence
  Synthetic polynucleotide
ttagtactgttgggagttgc

SEQ ID NO: 10390 - DNA, 20 bp, Artificial Sequence
  Synthetic polynucleotide
ctctggttgctgtttcaaat

SEQ ID NO: 10391 - DNA, 20 bp, Artificial Sequence
  Synthetic polynucleotide
aatcacgggagaatatgagc

SEQ ID NO: 10392 - DNA, 20 bp, Artificial Sequence
  Synthetic polynucleotide
ttgaccacttggagaaacaa

SEQ ID NO: 10393 - DNA, 20 bp, Artificial Sequence
  Synthetic polynucleotide
atgagagatgatgatggtgc

SEQ ID NO: 10394 - DNA, 20 bp, Artificial Sequence
  Synthetic polynucleotide
tcatcaaggagcccagtata

SEQ ID NO: 10395 - DNA, 20 bp, Artificial Sequence
  Synthetic polynucleotide
gttggttgcaccttctagta

SEQ ID NO: 10396 - DNA, 20 bp, Artificial Sequence
  Synthetic polynucleotide
tccgcaatagttgacaagaa

SEQ ID NO: 10397 - DNA, 21 bp, Artificial Sequence
  Synthetic polynucleotide
tgaatccctttcagtttgaac

SEQ ID NO: 10398 - DNA, 20 bp, Artificial Sequence
  Synthetic polynucleotide
ttgactaggttggtcttgtg

SEQ ID NO: 10399 - DNA, 20 bp, Artificial Sequence
  Synthetic polynucleotide
aatagcacaacagcaacaac

SEQ ID NO: 10400 - DNA, 20 bp, Artificial Sequence
  Synthetic polynucleotide
aacaatacgaggtttcacca

SEQ ID NO: 10401 - DNA, 20 bp, Artificial Sequence
  Synthetic polynucleotide
ctatgcagatgagatggctt

SEQ ID NO: 10402 - DNA, 20 bp, Artificial Sequence
  Synthetic polynucleotide
gccctagatagatctgcttg

SEQ ID NO: 10403 - DNA, 20 bp, Artificial Sequence
  Synthetic polynucleotide
ttggctgctgaaaagaaaag

SEQ ID NO: 10404 - DNA, 20 bp, Artificial Sequence
  Synthetic polynucleotide
tgttcatcagaggttggaag

SEQ ID NO: 10405 - DNA, 20 bp, Artificial Sequence
  Synthetic polynucleotide
gatttgcatttatccagcgt

SEQ ID NO: 10406 - DNA, 20 bp, Artificial Sequence
  Synthetic polynucleotide
gcacatgcatgaagtatgac

SEQ ID NO: 10407 - DNA, 20 bp, Artificial Sequence
  Synthetic polynucleotide
gcttgttgaagaagagggta

SEQ ID NO: 10408 - DNA, 20 bp, Artificial Sequence
  Synthetic polynucleotide
caaagcagtgttacctctct

SEQ ID NO: 10409 - DNA, 20 bp, Artificial Sequence
  Synthetic polynucleotide
ttacttgacgaacttctgca

SEQ ID NO: 10410 - DNA, 20 bp, Artificial Sequence
  Synthetic polynucleotide
gtcctctcatcaccatttgt

SEQ ID NO: 10411 - DNA, 20 bp, Artificial Sequence
  Synthetic polynucleotide
ctacagggaccagcatttta

SEQ ID NO: 10412 - DNA, 20 bp, Artificial Sequence
  Synthetic polynucleotide
gtccagcatcgtattctctt

SEQ ID NO: 10413 - DNA, 20 bp, Artificial Sequence
  Synthetic polynucleotide
aaatcatggtcacgaggaaa

SEQ ID NO: 10414 - DNA, 20 bp, Artificial Sequence
  Synthetic polynucleotide
ggccatttgttttcgtgtat

SEQ ID NO: 10415 - DNA, 20 bp, Artificial Sequence
  Synthetic polynucleotide
aaaaacgacgatccttctga

SEQ ID NO: 10416 - DNA, 20 bp, Artificial Sequence
  Synthetic polynucleotide
ccaaacacgtaagcttttgt

SEQ ID NO: 10417 - DNA, 20 bp, Artificial Sequence
  Synthetic polynucleotide
gcaagaggttcagaaagttg

SEQ ID NO: 10418 - DNA, 20 bp, Artificial Sequence
  Synthetic polynucleotide
ttagagccaagtaaaccacc

SEQ ID NO: 10419 - DNA, 20 bp, Artificial Sequence
  Synthetic polynucleotide
tttgcatgacagaacacttg

SEQ ID NO: 10420 - DNA, 20 bp, Artificial Sequence
  Synthetic polynucleotide
caaaagtgaaagagcagcaa

SEQ ID NO: 10421 - DNA, 20 bp, Artificial Sequence
  Synthetic polynucleotide
aaacacaagacctagctctg

SEQ ID NO: 10422 - DNA, 20 bp, Artificial Sequence
  Synthetic polynucleotide
acatggggtacaatgtcttc

SEQ ID NO: 10423 - DNA, 20 bp, Artificial Sequence
  Synthetic polynucleotide
aattctatcgcaggattccc

SEQ ID NO: 10424 - DNA, 20 bp, Artificial Sequence
  Synthetic polynucleotide
ctgtcctagcttgtttcctt

SEQ ID NO: 10425 - DNA, 20 bp, Artificial Sequence
  Synthetic polynucleotide
tgcaagattcgaggacattt

SEQ ID NO: 10426 - DNA, 19 bp, Artificial Sequence
  Synthetic polynucleotide
ctctacccattgccattcc

SEQ ID NO: 10427 - DNA, 20 bp, Artificial Sequence
  Synthetic polynucleotide
tattctcggatgtccatgtg

SEQ ID NO: 10428 - DNA, 20 bp, Artificial Sequence
  Synthetic polynucleotide
cctccataaggcttaagcaa

SEQ ID NO: 10429 - DNA, 20 bp, Artificial Sequence
  Synthetic polynucleotide
gatcaggatagctgatgcaa

SEQ ID NO: 10430 - DNA, 20 bp, Artificial Sequence
  Synthetic polynucleotide
ctctgagcatcctcttcttc

SEQ ID NO: 10431 - DNA, 20 bp, Artificial Sequence
  Synthetic polynucleotide
acagaaggtaaagcgatgtt

SEQ ID NO: 10432 - DNA, 20 bp, Artificial Sequence
  Synthetic polynucleotide
ctatctgttcctctgacagc

SEQ ID NO: 10433 - DNA, 20 bp, Artificial Sequence
  Synthetic polynucleotide
gtcttgcggaacaaattagg

SEQ ID NO: 10434 - DNA, 20 bp, Artificial Sequence
  Synthetic polynucleotide
tcctcacggctttcataaaa

SEQ ID NO: 10435 - DNA, 20 bp, Artificial Sequence
  Synthetic polynucleotide
tatggaagccatcagtcatg

SEQ ID NO: 10436 - DNA, 20 bp, Artificial Sequence
  Synthetic polynucleotide
tcttgaacttcatcaggagg

SEQ ID NO: 10437 - DNA, 20 bp, Artificial Sequence
  Synthetic polynucleotide
cataactcttttgctgccag

SEQ ID NO: 10438 - DNA, 20 bp, Artificial Sequence
  Synthetic polynucleotide
catcgatcactgctaactga

SEQ ID NO: 10439 - DNA, 20 bp, Artificial Sequence
  Synthetic polynucleotide
acgggatactacacctacaa

SEQ ID NO: 10440 - DNA, 20 bp, Artificial Sequence
  Synthetic polynucleotide
gatcgttgtcgcatttatcc

SEQ ID NO: 10441 - DNA, 20 bp, Artificial Sequence
  Synthetic polynucleotide
taaggacattcgttgaagca

SEQ ID NO: 10442 - DNA, 20 bp, Artificial Sequence
  Synthetic polynucleotide
gtccatcacaagtaacaggt

SEQ ID NO: 10443 - DNA, 20 bp, Artificial Sequence
  Synthetic polynucleotide
tgtcgctattgcttcagatt

SEQ ID NO: 10444 - DNA, 20 bp, Artificial Sequence
  Synthetic polynucleotide
aaagtgcatctctgtcacaa

SEQ ID NO: 10445 - DNA, 20 bp, Artificial Sequence
  Synthetic polynucleotide
gttcttgcaaataggatggc

SEQ ID NO: 10446 - DNA, 20 bp, Artificial Sequence
  Synthetic polynucleotide
ctatgtgtgtgtttggagga

SEQ ID NO: 10447 - DNA, 20 bp, Artificial Sequence
  Synthetic polynucleotide
taagatcctaccccagaagg

SEQ ID NO: 10448 - DNA, 20 bp, Artificial Sequence
  Synthetic polynucleotide
gaatgtctgctcgaggtatt

SEQ ID NO: 10449 - DNA, 20 bp, Artificial Sequence
  Synthetic polynucleotide
cgaaccgactttagaagagt

SEQ ID NO: 10450 - DNA, 20 bp, Artificial Sequence
  Synthetic polynucleotide
gaagttggtatccctggttt

SEQ ID NO: 10451 - DNA, 20 bp, Artificial Sequence
  Synthetic polynucleotide
aacttagcgttgcaatagga

SEQ ID NO: 10452 - DNA, 20 bp, Artificial Sequence
  Synthetic polynucleotide
agccctcctttcaagttttt

SEQ ID NO: 10453 - DNA, 20 bp, Artificial Sequence
  Synthetic polynucleotide
tcatgaacgttcagtgtcat

SEQ ID NO: 10454 - DNA, 20 bp, Artificial Sequence
  Synthetic polynucleotide
gttgatgacaagggagactt

SEQ ID NO: 10455 - DNA, 20 bp, Artificial Sequence
  Synthetic polynucleotide
tcagttctgcatttctcctc

SEQ ID NO: 10456 - DNA, 20 bp, Artificial Sequence
  Synthetic polynucleotide
aacgtgcttattcctcagtt

SEQ ID NO: 10457 - DNA, 20 bp, Artificial Sequence
  Synthetic polynucleotide
agcttagcaccatactagga

SEQ ID NO: 10458 - DNA, 20 bp, Artificial Sequence
  Synthetic polynucleotide
gtctaaaaacgtcacgaacc

SEQ ID NO: 10459 - DNA, 20 bp, Artificial Sequence
  Synthetic polynucleotide
attgccaaatgttcagtgac

SEQ ID NO: 10460 - DNA, 22 bp, Artificial Sequence
  Synthetic polynucleotide
acgaatttcttcaggagttttt

SEQ ID NO: 10461 - DNA, 20 bp, Artificial Sequence
  Synthetic polynucleotide
gcagttccatgatttgatgg

SEQ ID NO: 10462 - DNA, 20 bp, Artificial Sequence
  Synthetic polynucleotide
tccataatggctgcttgatt

SEQ ID NO: 10463 - DNA, 20 bp, Artificial Sequence
  Synthetic polynucleotide
aagaaggaattccaccagac

SEQ ID NO: 10464 - DNA, 20 bp, Artificial Sequence
  Synthetic polynucleotide
ctgctttcctgcaaaaatca

SEQ ID NO: 10465 - DNA, 20 bp, Artificial Sequence
  Synthetic polynucleotide
tcggagatggtactacaagt

SEQ ID NO: 10466 - DNA, 20 bp, Artificial Sequence
  Synthetic polynucleotide
gacggaagcagacatatctt

SEQ ID NO: 10467 - DNA, 20 bp, Artificial Sequence
  Synthetic polynucleotide
ccctgttatggtcatttgga

SEQ ID NO: 10468 - DNA, 20 bp, Artificial Sequence
  Synthetic polynucleotide
aataagcctcagcatagctc

SEQ ID NO: 10469 - DNA, 20 bp, Artificial Sequence
  Synthetic polynucleotide
catgagagaacattgcacac

SEQ ID NO: 10470 - DNA, 20 bp, Artificial Sequence
  Synthetic polynucleotide
aacagtgttgtcttccagtt

SEQ ID NO: 10471 - DNA, 20 bp, Artificial Sequence
  Synthetic polynucleotide
cagaacttacacctgtcgaa

SEQ ID NO: 10472 - DNA, 20 bp, Artificial Sequence
  Synthetic polynucleotide
atttggcacatttctggttg

SEQ ID NO: 10473 - DNA, 20 bp, Artificial Sequence
  Synthetic polynucleotide
gtgggcctctgattctaaaa

SEQ ID NO: 10474 - DNA, 20 bp, Artificial Sequence
  Synthetic polynucleotide
cctcagaccattgttgaaga

SEQ ID NO: 10475 - DNA, 20 bp, Artificial Sequence
  Synthetic polynucleotide
catgaacagggaacagagaa

SEQ ID NO: 10476 - DNA, 20 bp, Artificial Sequence
  Synthetic polynucleotide
atctgcacctttcgaaatct

SEQ ID NO: 10477 - DNA, 20 bp, Artificial Sequence
  Synthetic polynucleotide
attaggttgttggaaggcaa

SEQ ID NO: 10478 - DNA, 20 bp, Artificial Sequence
  Synthetic polynucleotide
tctttcttggtgctttcctt

SEQ ID NO: 10479 - DNA, 20 bp, Artificial Sequence
  Synthetic polynucleotide
cacaagatgaagaggttgga

SEQ ID NO: 10480 - DNA, 20 bp, Artificial Sequence
  Synthetic polynucleotide
tacttcaaagagaccagcac

SEQ ID NO: 10481 - DNA, 20 bp, Artificial Sequence
  Synthetic polynucleotide
gcctagaacttatggtggtt

SEQ ID NO: 10482 - DNA, 22 bp, Artificial Sequence
  Synthetic polynucleotide
tgattgatattctgtcaccagt

SEQ ID NO: 10483 - DNA, 20 bp, Artificial Sequence
  Synthetic polynucleotide
tgggaatgaaagggaagatg

SEQ ID NO: 10484 - DNA, 20 bp, Artificial Sequence
  Synthetic polynucleotide
tgagattccttcacaggttg

SEQ ID NO: 10485 - DNA, 20 bp, Artificial Sequence
  Synthetic polynucleotide
gatgggtttgaattagctgc

SEQ ID NO: 10486 - DNA, 20 bp, Artificial Sequence
  Synthetic polynucleotide
ttgtcctttgtggtaccaaa

SEQ ID NO: 10487 - DNA, 22 bp, Artificial Sequence
  Synthetic polynucleotide
agtagtggaaaaggtgaaaaga

SEQ ID NO: 10488 - DNA, 20 bp, Artificial Sequence
  Synthetic polynucleotide
atgattacaaactccccagg

SEQ ID NO: 10489 - DNA, 20 bp, Artificial Sequence
  Synthetic polynucleotide
cgacttcggttacagttttg

SEQ ID NO: 10490 - DNA, 20 bp, Artificial Sequence
  Synthetic polynucleotide
gcaacaatttgtcttcacca

SEQ ID NO: 10491 - DNA, 20 bp, Artificial Sequence
  Synthetic polynucleotide
ccgattacaccaggttgaat

SEQ ID NO: 10492 - DNA, 20 bp, Artificial Sequence
  Synthetic polynucleotide
ccaggtacgtctgagtatct

SEQ ID NO: 10493 - DNA, 20 bp, Artificial Sequence
  Synthetic polynucleotide
gaaaattgccacacctcaaa

SEQ ID NO: 10494 - DNA, 20 bp, Artificial Sequence
  Synthetic polynucleotide
taacagtcatttctgctgct

SEQ ID NO: 10495 - DNA, 20 bp, Artificial Sequence
  Synthetic polynucleotide
tgaaactcttatgtgggagc

SEQ ID NO: 10496 - DNA, 20 bp, Artificial Sequence
  Synthetic polynucleotide
taggagctaccatcctttgt

SEQ ID NO: 10497 - DNA, 20 bp, Artificial Sequence
  Synthetic polynucleotide
gcccctaaattgaggtcttt

SEQ ID NO: 10498 - DNA, 20 bp, Artificial Sequence
  Synthetic polynucleotide
cgatgagaccaacctttcta

SEQ ID NO: 10499 - DNA, 20 bp, Artificial Sequence
  Synthetic polynucleotide
gaggtgtaaagaagcctcac

SEQ ID NO: 10500 - DNA, 18 bp, Artificial Sequence
  Synthetic polynucleotide
tgatggtgaccctcttgg

SEQ ID NO: 10501 - DNA, 20 bp, Artificial Sequence
  Synthetic polynucleotide
ataatgacaatgcaaagccg

SEQ ID NO: 10502 - DNA, 20 bp, Artificial Sequence
  Synthetic polynucleotide
cagaaagcttcgattccaac

SEQ ID NO: 10503 - DNA, 20 bp, Artificial Sequence
  Synthetic polynucleotide
aacaggctcttatcgatgac

SEQ ID NO: 10504 - DNA, 20 bp, Artificial Sequence
  Synthetic polynucleotide
acaatgtccattcgttctca

SEQ ID NO: 10505 - DNA, 20 bp, Artificial Sequence
  Synthetic polynucleotide
tgaagtacaacatgagtgca

SEQ ID NO: 10506 - DNA, 20 bp, Artificial Sequence
  Synthetic polynucleotide
atagttgtgccaaagccata

SEQ ID NO: 10507 - DNA, 20 bp, Artificial Sequence
  Synthetic polynucleotide
tgaactcactaaccagttgg

SEQ ID NO: 10508 - DNA, 20 bp, Artificial Sequence
  Synthetic polynucleotide
gcatataaccatgctcagga

SEQ ID NO: 10509 - DNA, 20 bp, Artificial Sequence
  Synthetic polynucleotide
cttatgctggatctgcagat

SEQ ID NO: 10510 - DNA, 20 bp, Artificial Sequence
  Synthetic polynucleotide
ccttcagctgttcttcttct

SEQ ID NO: 10511 - DNA, 20 bp, Artificial Sequence
  Synthetic polynucleotide
ccatcaggaagaagaggaag

SEQ ID NO: 10512 - DNA, 19 bp, Artificial Sequence
  Synthetic polynucleotide
taccctcgaggatgtaacc

SEQ ID NO: 10513 - DNA, 20 bp, Artificial Sequence
  Synthetic polynucleotide
catcagatgctcctgttgta

SEQ ID NO: 10514 - DNA, 20 bp, Artificial Sequence
  Synthetic polynucleotide
ctcttcttcttccaatgcct

SEQ ID NO: 10515 - DNA, 20 bp, Artificial Sequence
  Synthetic polynucleotide
gcgaagtagtgaaaccaatg

SEQ ID NO: 10516 - DNA, 20 bp, Artificial Sequence
  Synthetic polynucleotide
taatcgagcctcctcatttg

SEQ ID NO: 10517 - DNA, 20 bp, Artificial Sequence
  Synthetic polynucleotide
attttcaaagaggaactgcc

SEQ ID NO: 10518 - DNA, 20 bp, Artificial Sequence
  Synthetic polynucleotide
tgctttggactgatagctaa

SEQ ID NO: 10519 - DNA, 20 bp, Artificial Sequence
  Synthetic polynucleotide
gagggaaggttgtttcaagt

SEQ ID NO: 10520 - DNA, 20 bp, Artificial Sequence
  Synthetic polynucleotide
tcttctgcagttactacagc

SEQ ID NO: 10521 - DNA, 20 bp, Artificial Sequence
  Synthetic polynucleotide
gatcaggtcactcacaaagt

SEQ ID NO: 10522 - DNA, 20 bp, Artificial Sequence
  Synthetic polynucleotide
gcctggaagttaactggtaa

SEQ ID NO: 10523 - DNA, 20 bp, Artificial Sequence
  Synthetic polynucleotide
aacattttgaaagcccatgg

SEQ ID NO: 10524 - DNA, 20 bp, Artificial Sequence
  Synthetic polynucleotide
agattgaaagagcagcttca

SEQ ID NO: 10525 - DNA, 21 bp, Artificial Sequence
  Synthetic polynucleotide
tggtaacacactcgatgataa

SEQ ID NO: 10526 - DNA, 20 bp, Artificial Sequence
  Synthetic polynucleotide
ggtgactgttgcaatttgaa

SEQ ID NO: 10527 - DNA, 20 bp, Artificial Sequence
  Synthetic polynucleotide
attgcggctttatcgtctat

SEQ ID NO: 10528 - DNA, 20 bp, Artificial Sequence
  Synthetic polynucleotide
cgttcaactcagataggagg

SEQ ID NO: 10529 - DNA, 20 bp, Artificial Sequence
  Synthetic polynucleotide
ggaatcggactaacgaatca

SEQ ID NO: 10530 - DNA, 20 bp, Artificial Sequence
  Synthetic polynucleotide
aagcgatgcgtctaagtaat

SEQ ID NO: 10531 - DNA, 20 bp, Artificial Sequence
  Synthetic polynucleotide
ggagttgcaaatggttttga

SEQ ID NO: 10532 - DNA, 20 bp, Artificial Sequence
  Synthetic polynucleotide
aacctttgccttcaacaatg

SEQ ID NO: 10533 - DNA, 20 bp, Artificial Sequence
  Synthetic polynucleotide
gatcttgaagctgggatagg

SEQ ID NO: 10534 - DNA, 20 bp, Artificial Sequence
  Synthetic polynucleotide
ctcttccagctctttcttgt

SEQ ID NO: 10535 - DNA, 20 bp, Artificial Sequence
  Synthetic polynucleotide
aggagaaaggaagaagcttg

SEQ ID NO: 10536 - DNA, 20 bp, Artificial Sequence
  Synthetic polynucleotide
tttaacctggcttcttctcc

SEQ ID NO: 10537 - DNA, 20 bp, Artificial Sequence
  Synthetic polynucleotide
aactggacgtttagaggttc

SEQ ID NO: 10538 - DNA, 20 bp, Artificial Sequence
  Synthetic polynucleotide
aggtctcagaatagcaggat

SEQ ID NO: 10539 - DNA, 20 bp, Artificial Sequence
  Synthetic polynucleotide
ttgtcttcagttgaccaacc

SEQ ID NO: 10540 - DNA, 20 bp, Artificial Sequence
  Synthetic polynucleotide
ctgggctttctgttctgata

SEQ ID NO: 10541 - DNA, 20 bp, Artificial Sequence
  Synthetic polynucleotide
accattagcaagcaccaata

SEQ ID NO: 10542 - DNA, 20 bp, Artificial Sequence
  Synthetic polynucleotide
actgtcagccattgatgatt

SEQ ID NO: 10543 - DNA, 20 bp, Artificial Sequence
  Synthetic polynucleotide
tatcaaggcctggtctgata

SEQ ID NO: 10544 - DNA, 20 bp, Artificial Sequence
  Synthetic polynucleotide
ctagctttctttgcttcagc

SEQ ID NO: 10545 - DNA, 20 bp, Artificial Sequence
  Synthetic polynucleotide
caagagttaaggaacgggaa

SEQ ID NO: 10546 - DNA, 20 bp, Artificial Sequence
  Synthetic polynucleotide
tcaacacattcttgacggat

SEQ ID NO: 10547 - DNA, 20 bp, Artificial Sequence
  Synthetic polynucleotide
catgaaatccttggactgga

SEQ ID NO: 10548 - DNA, 20 bp, Artificial Sequence
  Synthetic polynucleotide
tcgaatatgtgtcagcgaat

SEQ ID NO: 10549 - DNA, 20 bp, Artificial Sequence
  Synthetic polynucleotide
atgcctataaagctgacgag

SEQ ID NO: 10550 - DNA, 20 bp, Artificial Sequence
  Synthetic polynucleotide
ccatcaacgacaacattgag

SEQ ID NO: 10551 - DNA, 20 bp, Artificial Sequence
  Synthetic polynucleotide
atgttcccagatctagagct

SEQ ID NO: 10552 - DNA, 20 bp, Artificial Sequence
  Synthetic polynucleotide
tccttcaagcccttaacttc

SEQ ID NO: 10553 - DNA, 20 bp, Artificial Sequence
  Synthetic polynucleotide
tcatggtcagagacaaatcg

SEQ ID NO: 10554 - DNA, 20 bp, Artificial Sequence
  Synthetic polynucleotide
cactcataggtggtggtaac

SEQ ID NO: 10555 - DNA, 20 bp, Artificial Sequence
  Synthetic polynucleotide
acctcttgttgttttcgagt

SEQ ID NO: 10556 - DNA, 20 bp, Artificial Sequence
  Synthetic polynucleotide
ctgcttgagctctcagtatc

SEQ ID NO: 10557 - DNA, 20 bp, Artificial Sequence
  Synthetic polynucleotide
caagtgtttcaaaagtcccc

SEQ ID NO: 10558 - DNA, 20 bp, Artificial Sequence
  Synthetic polynucleotide
atgaggtaatccacaaccac

SEQ ID NO: 10559 - DNA, 21 bp, Artificial Sequence
  Synthetic polynucleotide
aggaaaatgatcagatgacca

SEQ ID NO: 10560 - DNA, 20 bp, Artificial Sequence
  Synthetic polynucleotide
attgtgacttcctttggtca

SEQ ID NO: 10561 - DNA, 20 bp, Artificial Sequence
  Synthetic polynucleotide
tacagactggtatctctgca

SEQ ID NO: 10562 - DNA, 20 bp, Artificial Sequence
  Synthetic polynucleotide
ccaatagcatagcaggcata

SEQ ID NO: 10563 - DNA, 20 bp, Artificial Sequence
  Synthetic polynucleotide
gtcaggcaaagaagaagaga

SEQ ID NO: 10564 - DNA, 20 bp, Artificial Sequence
  Synthetic polynucleotide
tttcctgattgccataagct

SEQ ID NO: 10565 - DNA, 20 bp, Artificial Sequence
  Synthetic polynucleotide
cgatcaagccaaacaaagaa

SEQ ID NO: 10566 - DNA, 20 bp, Artificial Sequence
  Synthetic polynucleotide
tttcctgcagctttgtagat

SEQ ID NO: 10567 - DNA, 20 bp, Artificial Sequence
  Synthetic polynucleotide
acatttgtcaaacgccattt

SEQ ID NO: 10568 - DNA, 20 bp, Artificial Sequence
  Synthetic polynucleotide
caggatccatgttgacttca

SEQ ID NO: 10569 - DNA, 20 bp, Artificial Sequence
  Synthetic polynucleotide
tggatatccaaaccattgca

SEQ ID NO: 10570 - DNA, 20 bp, Artificial Sequence
  Synthetic polynucleotide
cgcaagtcctatttgctttt

SEQ ID NO: 10571 - DNA, 20 bp, Artificial Sequence
  Synthetic polynucleotide
ggatacttcaagaagcccaa

SEQ ID NO: 10572 - DNA, 20 bp, Artificial Sequence
  Synthetic polynucleotide
actcacggttcctattttcc

SEQ ID NO: 10573 - DNA, 20 bp, Artificial Sequence
  Synthetic polynucleotide
ggtatgttgcacatcctgat

SEQ ID NO: 10574 - DNA, 20 bp, Artificial Sequence
  Synthetic polynucleotide
tttcaggacgttctttttgc

SEQ ID NO: 10575 - DNA, 20 bp, Artificial Sequence
  Synthetic polynucleotide
cattagtcaaactgcagcag

SEQ ID NO: 10576 - DNA, 20 bp, Artificial Sequence
  Synthetic polynucleotide
gtccagttcagatggatctc

SEQ ID NO: 10577 - DNA, 20 bp, Artificial Sequence
  Synthetic polynucleotide
atactgaggcattgcaagaa

SEQ ID NO: 10578 - DNA, 20 bp, Artificial Sequence
  Synthetic polynucleotide
tttggcattcttgtgttgtc

SEQ ID NO: 10579 - DNA, 20 bp, Artificial Sequence
  Synthetic polynucleotide
ggaatcggactaacgaatca

SEQ ID NO: 10580 - DNA, 20 bp, Artificial Sequence
  Synthetic polynucleotide
aagcgatgcgtctaagtaat

SEQ ID NO: 10581 - DNA, 20 bp, Artificial Sequence
  Synthetic polynucleotide
gaatggccaatatgcgtatg

SEQ ID NO: 10582 - DNA, 20 bp, Artificial Sequence
  Synthetic polynucleotide
aacattcctgtgatcttccc

SEQ ID NO: 10583 - DNA, 20 bp, Artificial Sequence
  Synthetic polynucleotide
ttctatggatattggtggcg

SEQ ID NO: 10584 - DNA, 20 bp, Artificial Sequence
  Synthetic polynucleotide
atcctgtccctcaacatttc

SEQ ID NO: 10585 - DNA, 20 bp, Artificial Sequence
  Synthetic polynucleotide
tggtgaagtaggagctacat

SEQ ID NO: 10586 - DNA, 20 bp, Artificial Sequence
  Synthetic polynucleotide
catcaactgtacaaccaacg

SEQ ID NO: 10587 - DNA, 20 bp, Artificial Sequence
  Synthetic polynucleotide
aaacagaaccacttggaact

SEQ ID NO: 10588 - DNA, 20 bp, Artificial Sequence
  Synthetic polynucleotide
cgttgatgtagagttcgtct

SEQ ID NO: 10589 - DNA, 20 bp, Artificial Sequence
  Synthetic polynucleotide
tatattacattcgccaccgg

SEQ ID NO: 10590 - DNA, 20 bp, Artificial Sequence
  Synthetic polynucleotide
tatcgcttgttggtactctg

SEQ ID NO: 10591 - DNA, 20 bp, Artificial Sequence
  Synthetic polynucleotide
tcgtaaaaacgacccttcat

SEQ ID NO: 10592 - DNA, 20 bp, Artificial Sequence
  Synthetic polynucleotide
ctgtccacaactgttccata

SEQ ID NO: 10593 - DNA, 20 bp, Artificial Sequence
  Synthetic polynucleotide
atcgagtctgattcagaacg

SEQ ID NO: 10594 - DNA, 20 bp, Artificial Sequence
  Synthetic polynucleotide
tttgcttccttcttctcctc

SEQ ID NO: 10595 - DNA, 20 bp, Artificial Sequence
  Synthetic polynucleotide
cgttcctctcctggttttaa

SEQ ID NO: 10596 - DNA, 20 bp, Artificial Sequence
  Synthetic polynucleotide
gtttcgaacgtgtagtgttc

SEQ ID NO: 10597 - DNA, 20 bp, Artificial Sequence
  Synthetic polynucleotide
tcaagttggaacctctaagc

SEQ ID NO: 10598 - DNA, 20 bp, Artificial Sequence
  Synthetic polynucleotide
ttccaagtctttctggtgag

SEQ ID NO: 10599 - DNA, 21 bp, Artificial Sequence
  Synthetic polynucleotide
gctggtaaaacaactcttctc

SEQ ID NO: 10600 - DNA, 22 bp, Artificial Sequence
  Synthetic polynucleotide
cagaactgaacacatgaatagt

SEQ ID NO: 10601 - DNA, 20 bp, Artificial Sequence
  Synthetic polynucleotide
acactgttcagagattgcat

SEQ ID NO: 10602 - DNA, 20 bp, Artificial Sequence
  Synthetic polynucleotide
atcgttactgacatctgctc

SEQ ID NO: 10603 - DNA, 20 bp, Artificial Sequence
  Synthetic polynucleotide
cgtgtaaagtactgcaacac

SEQ ID NO: 10604 - DNA, 20 bp, Artificial Sequence
  Synthetic polynucleotide
aatctctcctgcgtttttct

SEQ ID NO: 10605 - DNA, 20 bp, Artificial Sequence
  Synthetic polynucleotide
aagagcacgagaattcagtt

SEQ ID NO: 10606 - DNA, 20 bp, Artificial Sequence
  Synthetic polynucleotide
tcacaagaaacaccaaatgc

SEQ ID NO: 10607 - DNA, 20 bp, Artificial Sequence
  Synthetic polynucleotide
ggtatgttttgggcctctaa

SEQ ID NO: 10608 - DNA, 20 bp, Artificial Sequence
  Synthetic polynucleotide
ttatgatgggcctgattacg

SEQ ID NO: 10609 - DNA, 20 bp, Artificial Sequence
  Synthetic polynucleotide
tggttgatgtaccagttgag

SEQ ID NO: 10610 - DNA, 20 bp, Artificial Sequence
  Synthetic polynucleotide
gaagtgcacggataccttat

SEQ ID NO: 10611 - DNA, 20 bp, Artificial Sequence
  Synthetic polynucleotide
atggctggctctgaaattta

SEQ ID NO: 10612 - DNA, 20 bp, Artificial Sequence
  Synthetic polynucleotide
tcaataggtattccatgcgg

SEQ ID NO: 10613 - DNA, 20 bp, Artificial Sequence
  Synthetic polynucleotide
actcagagcttcagaagttg

SEQ ID NO: 10614 - DNA, 20 bp, Artificial Sequence
  Synthetic polynucleotide
acagtttgaaggggagattc

SEQ ID NO: 10615 - DNA, 20 bp, Artificial Sequence
  Synthetic polynucleotide
gtgatggctgctatacgtaa

SEQ ID NO: 10616 - DNA, 20 bp, Artificial Sequence
  Synthetic polynucleotide
agctctagttgctgtttcaa

SEQ ID NO: 10617 - DNA, 20 bp, Artificial Sequence
  Synthetic polynucleotide
agtgtcgatgtcatctaagc

SEQ ID NO: 10618 - DNA, 20 bp, Artificial Sequence
  Synthetic polynucleotide
gatcaattgcggatcgtaac

SEQ ID NO: 10619 - DNA, 20 bp, Artificial Sequence
  Synthetic polynucleotide
gcttttaggtgttggaatcg

SEQ ID NO: 10620 - DNA, 20 bp, Artificial Sequence
  Synthetic polynucleotide
actttgatgtgcagatccat

SEQ ID NO: 10621 - DNA, 20 bp, Artificial Sequence
  Synthetic polynucleotide
acgcagatcttgaactcttt

SEQ ID NO: 10622 - DNA, 20 bp, Artificial Sequence
  Synthetic polynucleotide
agaatggaataacggactcg

SEQ ID NO: 10623 - DNA, 21 bp, Artificial Sequence
  Synthetic polynucleotide
gaatccgtttcaattcgaact

SEQ ID NO: 10624 - DNA, 20 bp, Artificial Sequence
  Synthetic polynucleotide
tctgttgtctgttgttgttc

SEQ ID NO: 10625 - DNA, 20 bp, Artificial Sequence
  Synthetic polynucleotide
tgtccatcaacctgaagaag

SEQ ID NO: 10626 - DNA, 20 bp, Artificial Sequence
  Synthetic polynucleotide
acctgtgagtacgacttttc

SEQ ID NO: 10627 - DNA, 20 bp, Artificial Sequence
  Synthetic polynucleotide
gagatggcattcacatttgc

SEQ ID NO: 10628 - DNA, 19 bp, Artificial Sequence
  Synthetic polynucleotide
ccttctcgatctcagaggt

SEQ ID NO: 10629 - DNA, 20 bp, Artificial Sequence
  Synthetic polynucleotide
agatgctgctagatctttgg

SEQ ID NO: 10630 - DNA, 20 bp, Artificial Sequence
  Synthetic polynucleotide
tcacgttgcctttgatcata

SEQ ID NO: 10631 - DNA, 20 bp, Artificial Sequence
  Synthetic polynucleotide
acccagcttatttgaacagt

SEQ ID NO: 10632 - DNA, 20 bp, Artificial Sequence
  Synthetic polynucleotide
ttcagctttggaatcattgc

SEQ ID NO: 10633 - DNA, 20 bp, Artificial Sequence
  Synthetic polynucleotide
catcgaaacatcaccctttg

SEQ ID NO: 10634 - DNA, 20 bp, Artificial Sequence
  Synthetic polynucleotide
taccctcttcttcaacaagc

SEQ ID NO: 10635 - DNA, 20 bp, Artificial Sequence
  Synthetic polynucleotide
ttacttgacgaacttctgca

SEQ ID NO: 10636 - DNA, 20 bp, Artificial Sequence
  Synthetic polynucleotide
tagcaacatctttggctgat

SEQ ID NO: 10637 - DNA, 19 bp, Artificial Sequence
  Synthetic polynucleotide
caagagcgaacaggaagag

SEQ ID NO: 10638 - DNA, 19 bp, Artificial Sequence
  Synthetic polynucleotide
atcttcccgtatcctcctc

SEQ ID NO: 10639 - DNA, 20 bp, Artificial Sequence
  Synthetic polynucleotide
aacattttcagattggcagc

SEQ ID NO: 10640 - DNA, 20 bp, Artificial Sequence
  Synthetic polynucleotide
gctaattgactttgagtggc

SEQ ID NO: 10641 - DNA, 20 bp, Artificial Sequence
  Synthetic polynucleotide
gctttaccacctgttgagta

SEQ ID NO: 10642 - DNA, 20 bp, Artificial Sequence
  Synthetic polynucleotide
cctttggtatgtcctttcca

SEQ ID NO: 10643 - DNA, 20 bp, Artificial Sequence
  Synthetic polynucleotide
aaaagcaggaggttcagaaa

SEQ ID NO: 10644 - DNA, 20 bp, Artificial Sequence
  Synthetic polynucleotide
ctgacttagagccaagcaaa

SEQ ID NO: 10645 - DNA, 20 bp, Artificial Sequence
  Synthetic polynucleotide
gtacaacagagcacttgaga

SEQ ID NO: 10646 - DNA, 20 bp, Artificial Sequence
  Synthetic polynucleotide
tctcctaacagtgacaaagc

SEQ ID NO: 10647 - DNA, 20 bp, Artificial Sequence
  Synthetic polynucleotide
cgtttaaatcaggttctggc

SEQ ID NO: 10648 - DNA, 20 bp, Artificial Sequence
  Synthetic polynucleotide
gcagctgtgttgttatcttc

SEQ ID NO: 10649 - DNA, 20 bp, Artificial Sequence
  Synthetic polynucleotide
gatggatgcaatggtcaaag

SEQ ID NO: 10650 - DNA, 20 bp, Artificial Sequence
  Synthetic polynucleotide
agaagccaattcttcaggag

SEQ ID NO: 10651 - DNA, 21 bp, Artificial Sequence
  Synthetic polynucleotide
ttgcaagattcaaggacattc

SEQ ID NO: 10652 - DNA, 19 bp, Artificial Sequence
  Synthetic polynucleotide
ctctacccattgccattcc

SEQ ID NO: 10653 - DNA, 20 bp, Artificial Sequence
  Synthetic polynucleotide
tttgggccaaagatttgttc

SEQ ID NO: 10654 - DNA, 20 bp, Artificial Sequence
  Synthetic polynucleotide
accggaaatgtgttcataca

SEQ ID NO: 10655 - DNA, 20 bp, Artificial Sequence
  Synthetic polynucleotide
ttttgtcaacattcgtgtgg

SEQ ID NO: 10656 - DNA, 20 bp, Artificial Sequence
  Synthetic polynucleotide
tgccatatgagctttcaact

SEQ ID NO: 10657 - DNA, 20 bp, Artificial Sequence
  Synthetic polynucleotide
ggtgaggttggtcaagtatt

SEQ ID NO: 10658 - DNA, 20 bp, Artificial Sequence
  Synthetic polynucleotide
cttagatctgttgagcctcc

SEQ ID NO: 10659 - DNA, 20 bp, Artificial Sequence
  Synthetic polynucleotide
gtttccagtgcaattgttga

SEQ ID NO: 10660 - DNA, 20 bp, Artificial Sequence
  Synthetic polynucleotide
ttctcactgccttcatgaaa

SEQ ID NO: 10661 - DNA, 20 bp, Artificial Sequence
  Synthetic polynucleotide
gcaatggaagctatatccca

SEQ ID NO: 10662 - DNA, 20 bp, Artificial Sequence
  Synthetic polynucleotide
tttccacttctgtactgctc

SEQ ID NO: 10663 - DNA, 20 bp, Artificial Sequence
  Synthetic polynucleotide
atttgggaaaacaggaaggt

SEQ ID NO: 10664 - DNA, 20 bp, Artificial Sequence
  Synthetic polynucleotide
tacagctacaggactcatca

SEQ ID NO: 10665 - DNA, 20 bp, Artificial Sequence
  Synthetic polynucleotide
tgacttggaacatcaaggag

SEQ ID NO: 10666 - DNA, 20 bp, Artificial Sequence
  Synthetic polynucleotide
cgaaacttgtaggtaaccca

SEQ ID NO: 10667 - DNA, 20 bp, Artificial Sequence
  Synthetic polynucleotide
ttacactttgaagaggctcc

SEQ ID NO: 10668 - DNA, 20 bp, Artificial Sequence
  Synthetic polynucleotide
aaataggcttaggtggttgg

SEQ ID NO: 10669 - DNA, 20 bp, Artificial Sequence
  Synthetic polynucleotide
ggagcagatacacgtctaag

SEQ ID NO: 10670 - DNA, 20 bp, Artificial Sequence
  Synthetic polynucleotide
cttttccttcgttgtcgaga

SEQ ID NO: 10671 - DNA, 20 bp, Artificial Sequence
  Synthetic polynucleotide
gctctaccagaagaacaaca

SEQ ID NO: 10672 - DNA, 20 bp, Artificial Sequence
  Synthetic polynucleotide
ccggcatcctacctactata

SEQ ID NO: 10673 - DNA, 20 bp, Artificial Sequence
  Synthetic polynucleotide
aggacttatatggccctgat

SEQ ID NO: 10674 - DNA, 20 bp, Artificial Sequence
  Synthetic polynucleotide
aacatcggtcattgtcttga

SEQ ID NO: 10675 - DNA, 20 bp, Artificial Sequence
  Synthetic polynucleotide
acgaattggagcagaaaatg

SEQ ID NO: 10676 - DNA, 20 bp, Artificial Sequence
  Synthetic polynucleotide
cttcgggactctgcatatac

SEQ ID NO: 10677 - DNA, 20 bp, Artificial Sequence
  Synthetic polynucleotide
ggataagagatgtttgggca

SEQ ID NO: 10678 - DNA, 20 bp, Artificial Sequence
  Synthetic polynucleotide
cgtaaagatggccagaaaac

SEQ ID NO: 10679 - DNA, 20 bp, Artificial Sequence
  Synthetic polynucleotide
tctggtactggtaaaactgc

SEQ ID NO: 10680 - DNA, 20 bp, Artificial Sequence
  Synthetic polynucleotide
aactaacttgctgaacgtct

SEQ ID NO: 10681 - DNA, 20 bp, Artificial Sequence
  Synthetic polynucleotide
agctggagatggtactacat

SEQ ID NO: 10682 - DNA, 20 bp, Artificial Sequence
  Synthetic polynucleotide
tactagatcagctgacacca

SEQ ID NO: 10683 - DNA, 20 bp, Artificial Sequence
  Synthetic polynucleotide
gtccactacaggttccaatt

SEQ ID NO: 10684 - DNA, 20 bp, Artificial Sequence
  Synthetic polynucleotide
ttccaaatccacctcttcag

SEQ ID NO: 10685 - DNA, 20 bp, Artificial Sequence
  Synthetic polynucleotide
gcaaaatgctcagtaaccat

SEQ ID NO: 10686 - DNA, 20 bp, Artificial Sequence
  Synthetic polynucleotide
aagttttgcgaatttcctcc

SEQ ID NO: 10687 - DNA, 20 bp, Artificial Sequence
  Synthetic polynucleotide
tgataaggcgtcctgtaaag

SEQ ID NO: 10688 - DNA, 20 bp, Artificial Sequence
  Synthetic polynucleotide
ccaattgtaaccctccatga

SEQ ID NO: 10689 - DNA, 20 bp, Artificial Sequence
  Synthetic polynucleotide
cttcacttggttcttcgact

SEQ ID NO: 10690 - DNA, 20 bp, Artificial Sequence
  Synthetic polynucleotide
taatctgataaggttcggcc

SEQ ID NO: 10691 - DNA, 20 bp, Artificial Sequence
  Synthetic polynucleotide
ctagatattgtccacccagc

SEQ ID NO: 10692 - DNA, 20 bp, Artificial Sequence
  Synthetic polynucleotide
gccacatctccaataggtag

SEQ ID NO: 10693 - DNA, 20 bp, Artificial Sequence
  Synthetic polynucleotide
catgctgttgatgacttgtc

SEQ ID NO: 10694 - DNA, 20 bp, Artificial Sequence
  Synthetic polynucleotide
tttggcgaagtctatcacaa

SEQ ID NO: 10695 - DNA, 20 bp, Artificial Sequence
  Synthetic polynucleotide
tggaaatgaagtggggtatg

SEQ ID NO: 10696 - DNA, 20 bp, Artificial Sequence
  Synthetic polynucleotide
gaagctttggatattggcac

SEQ ID NO: 10697 - DNA, 20 bp, Artificial Sequence
  Synthetic polynucleotide
ggatgaatcaggatttgcca

SEQ ID NO: 10698 - DNA, 20 bp, Artificial Sequence
  Synthetic polynucleotide
atccaaatcatgcaaggtga

SEQ ID NO: 10699 - DNA, 20 bp, Artificial Sequence
  Synthetic polynucleotide
tacagttgtgtcacactcag

SEQ ID NO: 10700 - DNA, 20 bp, Artificial Sequence
  Synthetic polynucleotide
ccgaccttcaaagtcgatat

SEQ ID NO: 10701 - DNA, 20 bp, Artificial Sequence
  Synthetic polynucleotide
agatgttaggaaggacgaga

SEQ ID NO: 10702 - DNA, 20 bp, Artificial Sequence
  Synthetic polynucleotide
tagctggtggcatatttgtt

SEQ ID NO: 10703 - DNA, 20 bp, Artificial Sequence
  Synthetic polynucleotide
gctttgcagttccttttgat

SEQ ID NO: 10704 - DNA, 20 bp, Artificial Sequence
  Synthetic polynucleotide
cctcttctttctttccctcc

SEQ ID NO: 10705 - DNA, 20 bp, Artificial Sequence
  Synthetic polynucleotide
ttgaaaggtgtgatggtcaa

SEQ ID NO: 10706 - DNA, 20 bp, Artificial Sequence
  Synthetic polynucleotide
tgctcttagagtcgttaacg

SEQ ID NO: 10707 - DNA, 20 bp, Artificial Sequence
  Synthetic polynucleotide
ggagcagatacacgtctaag

SEQ ID NO: 10708 - DNA, 20 bp, Artificial Sequence
  Synthetic polynucleotide
cttttccttcgttgtcgaga

SEQ ID NO: 10709 - DNA, 20 bp, Artificial Sequence
  Synthetic polynucleotide
atgaaagacaggacgttgaa

SEQ ID NO: 10710 - DNA, 20 bp, Artificial Sequence
  Synthetic polynucleotide
tggtcgcctgataaatttca

SEQ ID NO: 10711 - DNA, 20 bp, Artificial Sequence
  Synthetic polynucleotide
aaatggaaggaaaggttggt

SEQ ID NO: 10712 - DNA, 20 bp, Artificial Sequence
  Synthetic polynucleotide
agaacatgaacggatgacaa

SEQ ID NO: 10713 - DNA, 20 bp, Artificial Sequence
  Synthetic polynucleotide
taaaaagtggaatgctgtgg

SEQ ID NO: 10714 - DNA, 20 bp, Artificial Sequence
  Synthetic polynucleotide
aaccatcttgaaatgcagtg

SEQ ID NO: 10715 - DNA, 20 bp, Artificial Sequence
  Synthetic polynucleotide
gcccaaaggaatggataaga

SEQ ID NO: 10716 - DNA, 20 bp, Artificial Sequence
  Synthetic polynucleotide
cagctattttggccattgag

SEQ ID NO: 10717 - DNA, 20 bp, Artificial Sequence
  Synthetic polynucleotide
gcgtcttcatcaggtagaat

SEQ ID NO: 10718 - DNA, 20 bp, Artificial Sequence
  Synthetic polynucleotide
tcttctttcctctccctcaa

SEQ ID NO: 10719 - DNA, 20 bp, Artificial Sequence
  Synthetic polynucleotide
gcagcatgatattcctgaga

SEQ ID NO: 10720 - DNA, 20 bp, Artificial Sequence
  Synthetic polynucleotide
gtgaagtttacccacagcta

SEQ ID NO: 10721 - DNA, 20 bp, Artificial Sequence
  Synthetic polynucleotide
cgggtaactatgatgcatca

SEQ ID NO: 10722 - DNA, 20 bp, Artificial Sequence
  Synthetic polynucleotide
ggtctaggtgtagatccagt

SEQ ID NO: 10723 - DNA, 20 bp, Artificial Sequence
  Synthetic polynucleotide
gagcaccaaaattgcgttat

SEQ ID NO: 10724 - DNA, 20 bp, Artificial Sequence
  Synthetic polynucleotide
aatgagaccaaccttacgac

SEQ ID NO: 10725 - DNA, 20 bp, Artificial Sequence
  Synthetic polynucleotide
tactaaagcagctcgcaaaa

SEQ ID NO: 10726 - DNA, 20 bp, Artificial Sequence
  Synthetic polynucleotide
cgcacaaattcgtatcttcg

SEQ ID NO: 10727 - DNA, 20 bp, Artificial Sequence
  Synthetic polynucleotide
tggctgtcaatatttctgct

SEQ ID NO: 10728 - DNA, 20 bp, Artificial Sequence
  Synthetic polynucleotide
catactccatgctcacgtta

SEQ ID NO: 10729 - DNA, 20 bp, Artificial Sequence
  Synthetic polynucleotide
cagtactcgaaccagatcag

SEQ ID NO: 10730 - DNA, 20 bp, Artificial Sequence
  Synthetic polynucleotide
tacgttaagaactcgctgag

SEQ ID NO: 10731 - DNA, 20 bp, Artificial Sequence
  Synthetic polynucleotide
gactaccactgagacaacag

SEQ ID NO: 10732 - DNA, 20 bp, Artificial Sequence
  Synthetic polynucleotide
gatttctttgctgagtgtgg

SEQ ID NO: 10733 - DNA, 20 bp, Artificial Sequence
  Synthetic polynucleotide
agtgttttggagattcgtga

SEQ ID NO: 10734 - DNA, 20 bp, Artificial Sequence
  Synthetic polynucleotide
ctatactctaatcgagccgc

SEQ ID NO: 10735 - DNA, 20 bp, Artificial Sequence
  Synthetic polynucleotide
tgccaaagcccaattatttg

SEQ ID NO: 10736 - DNA, 20 bp, Artificial Sequence
  Synthetic polynucleotide
tacggtcgttttctctcatc

SEQ ID NO: 10737 - DNA, 20 bp, Artificial Sequence
  Synthetic polynucleotide
gaagtttgaattaggtcgcc

SEQ ID NO: 10738 - DNA, 20 bp, Artificial Sequence
  Synthetic polynucleotide
taaaatgtagccatctgccc

SEQ ID NO: 10739 - DNA, 20 bp, Artificial Sequence
  Synthetic polynucleotide
aatggggcttatgttaggtg

SEQ ID NO: 10740 - DNA, 20 bp, Artificial Sequence
  Synthetic polynucleotide
ttctcctccaaatgcctttt

SEQ ID NO: 10741 - DNA, 20 bp, Artificial Sequence
  Synthetic polynucleotide
tcgtctacaagcacaaagaa

SEQ ID NO: 10742 - DNA, 20 bp, Artificial Sequence
  Synthetic polynucleotide
cttcagaatcaccaccagaa

SEQ ID NO: 10743 - DNA, 20 bp, Artificial Sequence
  Synthetic polynucleotide
tatacaagggccctacttca

SEQ ID NO: 10744 - DNA, 20 bp, Artificial Sequence
  Synthetic polynucleotide
gcatgctcaatccttctgat

SEQ ID NO: 10745 - DNA, 20 bp, Artificial Sequence
  Synthetic polynucleotide
aggacgtttattccaagtgg

SEQ ID NO: 10746 - DNA, 20 bp, Artificial Sequence
  Synthetic polynucleotide
tacatttcagcacctcttcc

SEQ ID NO: 10747 - DNA, 20 bp, Artificial Sequence
  Synthetic polynucleotide
atctcaccagcaaacagaat

SEQ ID NO: 10748 - DNA, 20 bp, Artificial Sequence
  Synthetic polynucleotide
tcttatccgtgacgagtttc

SEQ ID NO: 10749 - DNA, 20 bp, Artificial Sequence
  Synthetic polynucleotide
gatgttggagaagtaacggt

SEQ ID NO: 10750 - DNA, 20 bp, Artificial Sequence
  Synthetic polynucleotide
ctctccacgaagtacttcag

SEQ ID NO: 10751 - DNA, 20 bp, Artificial Sequence
  Synthetic polynucleotide
accaagtgaaacccaatgat

SEQ ID NO: 10752 - DNA, 20 bp, Artificial Sequence
  Synthetic polynucleotide
ccctcgatcttaacaccttc

SEQ ID NO: 10753 - DNA, 20 bp, Artificial Sequence
  Synthetic polynucleotide
agattagcacaagagcaaca

SEQ ID NO: 10754 - DNA, 20 bp, Artificial Sequence
  Synthetic polynucleotide
tgggttgtgaaaagagacaa

SEQ ID NO: 10755 - DNA, 20 bp, Artificial Sequence
  Synthetic polynucleotide
gtactgtttgggctactcaa

SEQ ID NO: 10756 - DNA, 20 bp, Artificial Sequence
  Synthetic polynucleotide
tagtgattcaactggtggtg

SEQ ID NO: 10757 - DNA, 20 bp, Artificial Sequence
  Synthetic polynucleotide
attgctgaggaagttaccag

SEQ ID NO: 10758 - DNA, 20 bp, Artificial Sequence
  Synthetic polynucleotide
taaaactgatccgctgaaca

SEQ ID NO: 10759 - DNA, 20 bp, Artificial Sequence
  Synthetic polynucleotide
gattctggaatccaccttgt

SEQ ID NO: 10760 - DNA, 20 bp, Artificial Sequence
  Synthetic polynucleotide
tcaagaatcatctgcgagag

SEQ ID NO: 10761 - DNA, 20 bp, Artificial Sequence
  Synthetic polynucleotide
acgccagaaagttgttagat

SEQ ID NO: 10762 - DNA, 20 bp, Artificial Sequence
  Synthetic polynucleotide
caagtctgagatcctcgaag

SEQ ID NO: 10763 - DNA, 20 bp, Artificial Sequence
  Synthetic polynucleotide
aagagctcacatgtcattgt

SEQ ID NO: 10764 - DNA, 20 bp, Artificial Sequence
  Synthetic polynucleotide
tatccctgacattagcctca

SEQ ID NO: 10765 - DNA, 20 bp, Artificial Sequence
  Synthetic polynucleotide
cagtagaccagcctttgaaa

SEQ ID NO: 10766 - DNA, 19 bp, Artificial Sequence
  Synthetic polynucleotide
ctcttagagcctgctgttg

SEQ ID NO: 10767 - DNA, 20 bp, Artificial Sequence
  Synthetic polynucleotide
acgtttacaataaaccggga

SEQ ID NO: 10768 - DNA, 20 bp, Artificial Sequence
  Synthetic polynucleotide
agcatcaacaggctgataaa

SEQ ID NO: 10769 - DNA, 20 bp, Artificial Sequence
  Synthetic polynucleotide
agaagtcgtcaaagaaacga

SEQ ID NO: 10770 - DNA, 20 bp, Artificial Sequence
  Synthetic polynucleotide
acccttcttttccaaggaag

SEQ ID NO: 10771 - DNA, 20 bp, Artificial Sequence
  Synthetic polynucleotide
gtatgacataagggcggaat

SEQ ID NO: 10772 - DNA, 20 bp, Artificial Sequence
  Synthetic polynucleotide
caaatggtcgaagcctttac

SEQ ID NO: 10773 - DNA, 20 bp, Artificial Sequence
  Synthetic polynucleotide
atgtttatgctgcccttgta

SEQ ID NO: 10774 - DNA, 20 bp, Artificial Sequence
  Synthetic polynucleotide
atcttcttcatcgtcttcgg

SEQ ID NO: 10775 - DNA, 20 bp, Artificial Sequence
  Synthetic polynucleotide
tgtcaagaagaatggtcctg

SEQ ID NO: 10776 - DNA, 20 bp, Artificial Sequence
  Synthetic polynucleotide
ttagttcgtgtaacaagggg

SEQ ID NO: 10777 - DNA, 20 bp, Artificial Sequence
  Synthetic polynucleotide
ctcaaagaaagatgttccgc

SEQ ID NO: 10778 - DNA, 20 bp, Artificial Sequence
  Synthetic polynucleotide
cgtagttcagaacggttttg

SEQ ID NO: 10779 - DNA, 20 bp, Artificial Sequence
  Synthetic polynucleotide
cttggtcagaaacaaatcgg

SEQ ID NO: 10780 - DNA, 20 bp, Artificial Sequence
  Synthetic polynucleotide
ctctctgttttgtaacccga

SEQ ID NO: 10781 - DNA, 20 bp, Artificial Sequence
  Synthetic polynucleotide
cctgtgaaactattaccggt

SEQ ID NO: 10782 - DNA, 19 bp, Artificial Sequence
  Synthetic polynucleotide
ttatcttccacgaccggta

SEQ ID NO: 10783 - DNA, 20 bp, Artificial Sequence
  Synthetic polynucleotide
ttggttcgagtttcggttat

SEQ ID NO: 10784 - DNA, 20 bp, Artificial Sequence
  Synthetic polynucleotide
atgtatgctctccagtacct

SEQ ID NO: 10785 - DNA, 21 bp, Artificial Sequence
  Synthetic polynucleotide
tcgaatgactcaagaactaca

SEQ ID NO: 10786 - DNA, 20 bp, Artificial Sequence
  Synthetic polynucleotide
agttgtgagatcctctggat

SEQ ID NO: 10787 - DNA, 20 bp, Artificial Sequence
  Synthetic polynucleotide
ttgacgtgatgaactccatt

SEQ ID NO: 10788 - DNA, 20 bp, Artificial Sequence
  Synthetic polynucleotide
ccttaccgatagcgtaacaa

SEQ ID NO: 10789 - DNA, 20 bp, Artificial Sequence
  Synthetic polynucleotide
aaattctggcctacggaaat

SEQ ID NO: 10790 - DNA, 20 bp, Artificial Sequence
  Synthetic polynucleotide
gctctcctctgtgtatcttg

SEQ ID NO: 10791 - DNA, 20 bp, Artificial Sequence
  Synthetic polynucleotide
gttgggagaaacagaaaagc

SEQ ID NO: 10792 - DNA, 20 bp, Artificial Sequence
  Synthetic polynucleotide
ggctcttgttcaaacaactc

SEQ ID NO: 10793 - DNA, 20 bp, Artificial Sequence
  Synthetic polynucleotide
cgacatttgtgaaacgtcat

SEQ ID NO: 10794 - DNA, 20 bp, Artificial Sequence
  Synthetic polynucleotide
atttgtttctgccattgtgg

SEQ ID NO: 10795 - DNA, 20 bp, Artificial Sequence
  Synthetic polynucleotide
gggaatttttgggagtaggt

SEQ ID NO: 10796 - DNA, 20 bp, Artificial Sequence
  Synthetic polynucleotide
caaatatgctgcaccattca

SEQ ID NO: 10797 - DNA, 20 bp, Artificial Sequence
  Synthetic polynucleotide
cagtactgttgggttcatga

SEQ ID NO: 10798 - DNA, 20 bp, Artificial Sequence
  Synthetic polynucleotide
catctaagggaagttctccg

SEQ ID NO: 10799 - DNA, 20 bp, Artificial Sequence
  Synthetic polynucleotide
tgtggctcatcctgataaac

SEQ ID NO: 10800 - DNA, 20 bp, Artificial Sequence
  Synthetic polynucleotide
gcaatggctttgagaacatt

SEQ ID NO: 10801 - DNA, 20 bp, Artificial Sequence
  Synthetic polynucleotide
ggaaccattaaagacagggt

SEQ ID NO: 10802 - DNA, 20 bp, Artificial Sequence
  Synthetic polynucleotide
taagcctctttgatgggaac

SEQ ID NO: 10803 - DNA, 20 bp, Artificial Sequence
  Synthetic polynucleotide
gctgcagtatcagaagctat

SEQ ID NO: 10804 - DNA, 20 bp, Artificial Sequence
  Synthetic polynucleotide
tgtttgctgtttcttttggg

SEQ ID NO: 10805 - DNA, 20 bp, Artificial Sequence
  Synthetic polynucleotide
tagggttaaacgacaaggac

SEQ ID NO: 10806 - DNA, 20 bp, Artificial Sequence
  Synthetic polynucleotide
tacttcggcttgaatccttt

SEQ ID NO: 10807 - DNA, 20 bp, Artificial Sequence
  Synthetic polynucleotide
acatctgccaaagtcatgat

SEQ ID NO: 10808 - DNA, 20 bp, Artificial Sequence
  Synthetic polynucleotide
gttgtcaatttccagcaaca

SEQ ID NO: 10809 - DNA, 20 bp, Artificial Sequence
  Synthetic polynucleotide
gctgtttgtgttgctaaact

SEQ ID NO: 10810 - DNA, 20 bp, Artificial Sequence
  Synthetic polynucleotide
gtagcaacacatctttctgc

SEQ ID NO: 10811 - DNA, 20 bp, Artificial Sequence
  Synthetic polynucleotide
gaagtgggagctacatcttc

SEQ ID NO: 10812 - DNA, 20 bp, Artificial Sequence
  Synthetic polynucleotide
ggcagttcctaaaacttcct

SEQ ID NO: 10813 - DNA, 20 bp, Artificial Sequence
  Synthetic polynucleotide
ttggtagaagctggtgtaac

SEQ ID NO: 10814 - DNA, 20 bp, Artificial Sequence
  Synthetic polynucleotide
caattttggcagatggatcc

SEQ ID NO: 10815 - DNA, 20 bp, Artificial Sequence
  Synthetic polynucleotide
gatttcattctccattcgcc

SEQ ID NO: 10816 - DNA, 20 bp, Artificial Sequence
  Synthetic polynucleotide
gacatcgtctggtagttctc

SEQ ID NO: 10817 - DNA, 20 bp, Artificial Sequence
  Synthetic polynucleotide
cttgaccactaacgaaaacg

SEQ ID NO: 10818 - DNA, 20 bp, Artificial Sequence
  Synthetic polynucleotide
acttcggtaccatatcgttg

SEQ ID NO: 10819 - DNA, 19 bp, Artificial Sequence
  Synthetic polynucleotide
tctttcttttcttcggcgg

SEQ ID NO: 10820 - DNA, 20 bp, Artificial Sequence
  Synthetic polynucleotide
aggaattgaagctgaaggag

SEQ ID NO: 10821 - DNA, 20 bp, Artificial Sequence
  Synthetic polynucleotide
ggagaccaatgtaccattgt

SEQ ID NO: 10822 - DNA, 20 bp, Artificial Sequence
  Synthetic polynucleotide
actcgatttgcttctgttct

SEQ ID NO: 10823 - DNA, 20 bp, Artificial Sequence
  Synthetic polynucleotide
acctaccactactacaggac

SEQ ID NO: 10824 - DNA, 20 bp, Artificial Sequence
  Synthetic polynucleotide
ggtgatttgctccaaatgag

SEQ ID NO: 10825 - DNA, 20 bp, Artificial Sequence
  Synthetic polynucleotide
ggacaatgctggaaaaacaa

SEQ ID NO: 10826 - DNA, 20 bp, Artificial Sequence
  Synthetic polynucleotide
ttcagaatggagcacatgaa

SEQ ID NO: 10827 - DNA, 21 bp, Artificial Sequence
  Synthetic polynucleotide
ttgtgttactttattgcgtgt

SEQ ID NO: 10828 - DNA, 22 bp, Artificial Sequence
  Synthetic polynucleotide
tgatctcattgtaatttcgcaa

SEQ ID NO: 10829 - DNA, 20 bp, Artificial Sequence
  Synthetic polynucleotide
cagagcagatagtggagttc

SEQ ID NO: 10830 - DNA, 20 bp, Artificial Sequence
  Synthetic polynucleotide
tacctcacgagagagttgat

SEQ ID NO: 10831 - DNA, 20 bp, Artificial Sequence
  Synthetic polynucleotide
gatgagagtggtgaacagtt

SEQ ID NO: 10832 - DNA, 20 bp, Artificial Sequence
  Synthetic polynucleotide
gatctggatctagacctcga

SEQ ID NO: 10833 - DNA, 20 bp, Artificial Sequence
  Synthetic polynucleotide
atttgtaaggactctggctg

SEQ ID NO: 10834 - DNA, 20 bp, Artificial Sequence
  Synthetic polynucleotide
ctagtaactgtgtgtaggcc

SEQ ID NO: 10835 - DNA, 20 bp, Artificial Sequence
  Synthetic polynucleotide
aacctacaatcagcgttctt

SEQ ID NO: 10836 - DNA, 19 bp, Artificial Sequence
  Synthetic polynucleotide
gtttccactgcctctcttg

SEQ ID NO: 10837 - DNA, 20 bp, Artificial Sequence
  Synthetic polynucleotide
gtcctgccttacacaaacta

SEQ ID NO: 10838 - DNA, 20 bp, Artificial Sequence
  Synthetic polynucleotide
cctcctgaataagttggctt

SEQ ID NO: 10839 - DNA, 20 bp, Artificial Sequence
  Synthetic polynucleotide
agactgaagctataacgcag

SEQ ID NO: 10840 - DNA, 20 bp, Artificial Sequence
  Synthetic polynucleotide
caactccttctcctcgtatg

SEQ ID NO: 10841 - DNA, 20 bp, Artificial Sequence
  Synthetic polynucleotide
tcttccgagggtctctttat

SEQ ID NO: 10842 - DNA, 20 bp, Artificial Sequence
  Synthetic polynucleotide
caatagccgttacgaattcg

SEQ ID NO: 10843 - DNA, 20 bp, Artificial Sequence
  Synthetic polynucleotide
ttggttattgtcggtgatgg

SEQ ID NO: 10844 - DNA, 21 bp, Artificial Sequence
  Synthetic polynucleotide
acaccttccttacttttagca

SEQ ID NO: 10845 - DNA, 20 bp, Artificial Sequence
  Synthetic polynucleotide
aggggtgcttattcgaaatt

SEQ ID NO: 10846 - DNA, 20 bp, Artificial Sequence
  Synthetic polynucleotide
ttgcgtggacaataaaggta

SEQ ID NO: 10847 - DNA, 20 bp, Artificial Sequence
  Synthetic polynucleotide
tgaggaagccttctttgtac

SEQ ID NO: 10848 - DNA, 20 bp, Artificial Sequence
  Synthetic polynucleotide
atcattgacaggtgcttgat

SEQ ID NO: 10849 - DNA, 20 bp, Artificial Sequence
  Synthetic polynucleotide
gagtcagatcgagcagaaat

SEQ ID NO: 10850 - DNA, 20 bp, Artificial Sequence
  Synthetic polynucleotide
tctgctactgacgacaaaaa

SEQ ID NO: 10851 - DNA, 21 bp, Artificial Sequence
  Synthetic polynucleotide
tcgaatgcatagaagaactga

SEQ ID NO: 10852 - DNA, 20 bp, Artificial Sequence
  Synthetic polynucleotide
gtacatcagctggagtactg

SEQ ID NO: 10853 - DNA, 20 bp, Artificial Sequence
  Synthetic polynucleotide
caacctagcacttctcaagt

SEQ ID NO: 10854 - DNA, 20 bp, Artificial Sequence
  Synthetic polynucleotide
taacacaacctttccggaaa

SEQ ID NO: 10855 - DNA, 20 bp, Artificial Sequence
  Synthetic polynucleotide
acaactgcgaagagaagtta

SEQ ID NO: 10856 - DNA, 20 bp, Artificial Sequence
  Synthetic polynucleotide
agttgtggctgacgataatt

SEQ ID NO: 10857 - DNA, 20 bp, Artificial Sequence
  Synthetic polynucleotide
attcgtcagttttctcggaa

SEQ ID NO: 10858 - DNA, 20 bp, Artificial Sequence
  Synthetic polynucleotide
gtttcaccatctagatcgct

SEQ ID NO: 10859 - DNA, 20 bp, Artificial Sequence
  Synthetic polynucleotide
gccccgataagaaacatagt

SEQ ID NO: 10860 - DNA, 20 bp, Artificial Sequence
  Synthetic polynucleotide
ttcccctgcacctttatttt

SEQ ID NO: 10861 - DNA, 20 bp, Artificial Sequence
  Synthetic polynucleotide
accatgcaagaaatttgtgg

SEQ ID NO: 10862 - DNA, 20 bp, Artificial Sequence
  Synthetic polynucleotide
atggctctttcatacgtctc

SEQ ID NO: 10863 - DNA, 20 bp, Artificial Sequence
  Synthetic polynucleotide
agggagaaggtactatggac

SEQ ID NO: 10864 - DNA, 20 bp, Artificial Sequence
  Synthetic polynucleotide
gtacctagcactcttgatgg

SEQ ID NO: 10865 - DNA, 20 bp, Artificial Sequence
  Synthetic polynucleotide
gtactagagctgagcaagac

SEQ ID NO: 10866 - DNA, 20 bp, Artificial Sequence
  Synthetic polynucleotide
cctcttccagagtcaaagtc

SEQ ID NO: 10867 - DNA, 20 bp, Artificial Sequence
  Synthetic polynucleotide
actacatcttcgccctacta

SEQ ID NO: 10868 - DNA, 20 bp, Artificial Sequence
  Synthetic polynucleotide
atgtagtagcaaagacctgc

SEQ ID NO: 10869 - DNA, 20 bp, Artificial Sequence
  Synthetic polynucleotide
cgtaaaagaaatgctgaccc

SEQ ID NO: 10870 - DNA, 20 bp, Artificial Sequence
  Synthetic polynucleotide
tttatctgaagttcccgcaa

SEQ ID NO: 10871 - DNA, 20 bp, Artificial Sequence
  Synthetic polynucleotide
tggcagtcaagaaagtagag

SEQ ID NO: 10872 - DNA, 20 bp, Artificial Sequence
  Synthetic polynucleotide
gtctcctgatttcgtctgag

SEQ ID NO: 10873 - DNA, 20 bp, Artificial Sequence
  Synthetic polynucleotide
gaagtacatcaaaagctgcc

SEQ ID NO: 10874 - DNA, 20 bp, Artificial Sequence
  Synthetic polynucleotide
tgctgctaaaccaaacaaag

SEQ ID NO: 10875 - DNA, 20 bp, Artificial Sequence
  Synthetic polynucleotide
atagcaaatctggtcagcaa

SEQ ID NO: 10876 - DNA, 20 bp, Artificial Sequence
  Synthetic polynucleotide
ttactcggattccaatcgtc

SEQ ID NO: 10877 - DNA, 20 bp, Artificial Sequence
  Synthetic polynucleotide
tccaaatgaaataagcgtgc

SEQ ID NO: 10878 - DNA, 20 bp, Artificial Sequence
  Synthetic polynucleotide
gaacagcaactaattctgcc

SEQ ID NO: 10879 - DNA, 20 bp, Artificial Sequence
  Synthetic polynucleotide
caggactcccgaacatttat

SEQ ID NO: 10880 - DNA, 19 bp, Artificial Sequence
  Synthetic polynucleotide
aggtcctctcattcccatc

SEQ ID NO: 10881 - DNA, 20 bp, Artificial Sequence
  Synthetic polynucleotide
gctcaaaagccgatatcaac

SEQ ID NO: 10882 - DNA, 20 bp, Artificial Sequence
  Synthetic polynucleotide
ctgagggtcgtaagtagttg

SEQ ID NO: 10883 - DNA, 20 bp, Artificial Sequence
  Synthetic polynucleotide
ccatactggcgaactattga

SEQ ID NO: 10884 - DNA, 20 bp, Artificial Sequence
  Synthetic polynucleotide
tcgtcttcgaaattggaact

SEQ ID NO: 10885 - protein, 687 aa, Sitophilus oryzae
  misc_feature (550)..(550): Xaa can be any naturally occurring amino acid
MPRSRSRDGKEHSSRSKHSHKKASRSPSYERKKSKSKRRSSSSRSSKRRDFKYVSKNRKRHDTDSDSSNSSSSSDSSSSSQNSLKLLEKLEKDRIRNLEEKKRQKELLKATETAEEKRLRRLKKKEEKERKRKERMGWDNEYLHYTNSDNPFGDGNLLSSFVWTKKLAKEGLTNASHEELEARNRFKQEENKRELEKVKKRRQERELDRQRRDEENQLLQRSKEAAQFEEWERQEDQFHLEQARLRSHIRIQDGRAKPIDLLAKYISAEEEVDAVEMHEPYTYLNGLHIKDLEDLVEDIKVYKELERGKNLDYWNDITVIVEDELQKMRKIQKEQDFDAGVGRREGINQAVAQDVTSVFKGKTAIQLAALQKQIESKISGKADGIDIGYWESLLSQLKAHMARARLRDRHQESLKRKLQVLKAEQAVALPENNQNIESTKHSDNEKPSTSQESTEDSQSDTEANENAANDILNECFILYQNGGYSPKLLSPDEIEPGTIVVTEEDDTNRLEFARMQVTAKGKKVENVITKEELLLQKEARKGMGEDEAQXARKGMGEDEAQFSVEQALDNQVYLWSDKYRPRKPRYFNRVHTGFEWNKYNQTHYDMDNPPPKIVQGYKFNIFYPDLIDKNCTPEYFLTPCPDNKEFAILKFHAGPPYEDIAFKIVNREWEYSYKRGFRCQFHNNIFQ

SEQ ID NO: 10886 - protein, 421 aa, Sitophilus oryzae
MDNLEANIMDKSMRSVFVGNIPYEATEEKLKDIFGEVGQVLSFKLVFDRETGKPKGYGFCEYRDQETALSAMRNLNSYEIGGRNLRVDNACTEKSRMEMQNLLNQPPVENPYGEPIQAEKAPEAISKAVASLPPEQMFELMKQMKSTIQNNPTEARQMLLQNPQLAYALLQAQVVMKIIDPHTAASLLHPVNQVPATLMPGDKNVPVQVPISAQFQQPPTPVAPPRQEFQPVPAPIMHPNSHNAPVFTGQDVDLRSLDPRGTSDPRLGRMADQDMRQLPPPSQLTNPLPPPVAESFSREPRDPRDPRAVGQSFPADPRQAARADPRQKTMVPPPTAVPPPSVRPPPVTSITSSPTSNQPSRASVASAVSGATNPGTSDQEKAALIMQVLQLSDEQIAMLPLEQRNSILVLKEQIAKSAQGR

SEQ ID NO: 10887 - protein, 403 aa, Sitophilus oryzae
  misc_feature (222)..(222): Xaa can be any naturally occurring amino acid
MEAEREKALQDYRKKLMEHKEVESRLKEMREQLKDLTKQYDKSENDLKALQSMGQIVGEVLKQLTEEKFIVKATNGPRYVVGCRRQLDKAKLKAGTRVALDMTTLTIMRYLPREVDPLVYNMSHEDPGDVTYSAIGGLSEQIRELREVIELPLLNPELFMRVGITPPKGCLLYGPPGTGKTLLARAVASQLDANFLKVVSSAIVDKYIGESARLIREMFNYXDKYIGESARLIREMFNYAKDHQPCIIFMDEIDAIGGRRFSEGTSADREIQRTLMELLNQMDGFDSLGQVKMIMATNRPDTLDPALLRPGRLDRKIEIPLPNEQARLEILKIHAGPIAKHGEIDYEAIVKLSDNFNGADLRNVCTEAGLFAIRSEREYVIQEDFMKAVRKVADNKKLESKLD

SEQ ID NO: 10888 - protein, 259 aa, Sitophilus oryzae
MARRYDTRTTIFSPEGRLYQVEYAMEAISLAGTCLGILANDGILLAAERRNTNKLLDEVFTSEKIYKLNDDMVCSVAGITSDANVLTNELRLIGQRYIFQYGESIPCEQLVSWLCDVKQAYTQYGGKRPFGVSILYMGWDKHYGYQLYQSDPSGNYSGWKATCIGNNSSAAISSLKQEYKEGEMTLNDAKSLAVKVLSKTLDMTKLTSEKVEMATLTRVNNKTVIHILTAKEVEELISQFEKSEAALEASKKEQQKVTA

SEQ ID NO: 10889 - protein, 890 aa, Sitophilus oryzae
MAEAKAEAPTKVEAKKDTEEDKNELSEEDKQLQDELNLCVERLTENDENLYLSALNVLGTKIRASTTSMTSVPKPLKFMKPHYDTMKQVYDKINNPNVKKVCADVVSVLAMTMGEARECLKYRLLSDLDQIREWGHEYVRHLAGEIAGEWADKEVDDKDMEVKLIQLAKQIVPYNMAHNAEAEACDLLMEIERLDLLEEYVDDNIYPRVCLYLTSCVPYVADPENTTLLQTALLLFRKFNQYPQSLRLALQLNDHALIEEIFLSCKDTTIQKQLAFMLGRQQIYIEIPETTPEYEDLAEIMANCHLNNHFLNLARELDIMEPKTPEDVYKSHLENTRPSFGGSQVDSARQNLAASFVNGFVNAAFGQDKLLMEDGNKWLYKNKEHGMLSATASLGLVLLWDVDGGLTPIDKYLYSSEDHIKSGALLACGIVNCGVRNECDPALALLSDYVLHNAPIMRTGAILGLGLAYVGSNREAVLSLLFPVFSDPKSNMEVIGMAALACGMIAVGSGNSQVTTTIMQTLMEKSETELKDTYARFLPLAIGLCHLGKQESIDTIIAALQVIPEPFRSMATTMVDICAYAGTGNVLKVQHLLHICSEHYEPPEPVEKDKKDKEKDKKEKPEEKEKDLSARQAIAVLGIALISMGEDIGSEMAFRTFGHLLRYCEPVIRRAVPLALGLISVSNPKLSILDTLSKFSHDSDAEVAHNAIFAMGLVGAGTNNARLAAMLRQLAQYHAKDPNNLFMVRIAQGLCHLGKGTLTLSPYHSDRQLMSPVAVAGLMATLVGFLDVKTIILGKSHYLLYTLAAAMQPRMLVTFDEDLNALPVPVRVGLAVDVVGQAGKPKTITGFQTHTTPVLLAHGERAELATEEYISLTPIMEGFVILRKNPDFNP

SEQ ID NO: 10890 - protein, 144 aa, Sitophilus oryzae
DSTGGPSQQYYITTQWPAPGNNMEDGGASVGTSGGQHQQRSGTETGNRRTGVSCANCKTVNTTLWRRNNQGEPVCNACGLYFKLHNVNRPISMKKEGIQTRKRRPKNSNSNQQHPNSPTTSGMHQQRMKLILPDSSTELRLMAV

SEQ ID NO: 10891 - protein, 1306 aa, Sitophilus oryzae
MALPGNGIFVVKGEMTILMAAMKRGTRWSSHSYLDEELDLLMKSFQELKELLSRIDDLRLIEPEVFLTPFLEVIRSEDTTGPVTSLALAAVNKFLSYGLIDPTHSSVPQTVHNIADAVTHARFVGTDQSSDGVVLMRILQVLRTLTLTPEGAMLTNESLCEIMLSCFRICFETRIHELLKKTAEYYLKDMVQLVFMRLPQFSDDVRSLSIKNLKMRAGTGVEQTKLKKKSRHSFRKKSQTEDRDAVEENVSISRSVSVETNSLNNVDNVVDVQNHLISTDAALEGNEQENIENISIESDKIQTENEEVTGEQPEINEVKNSESVSVNLETVQKQVSDSPESLNVPDQSVNSSDSNKEYVNQRGIRFTPQMIQPDDLVLIPYGLACVRELLRFLISLCNPNDKQNNEVMIHLGLTLLTVAFEVGADSIGKHAALLSLVKDDLCRNLFSLLNSERISIFAADLQVSFLMFESLRTNLKFQMEKYLTKLIEIVVSENQKVTYEHKEIALDNILQLWRIPGFVNELYLNYDCDMYCTNLYEDLTKLLAKNAYSASNGVWHTHLLSLDALLTVIEGIEMHCSDSKSSQDLPHSKKSTSESNETIESIGNIIGKHNRVKYSESVPPLDDLLAKKSIKKRLPQGTEHFNIKPKKGIQFFQEHGVLKSDSDNQEIALFLRENPALDKKMIGEYISNRNNLHILDAFVKTFSFTGVRIDEALRSFLETFRLPGEAPTISLILEQFAEHWHKSNGEPFADVDSAFTLAYAVIMLNVDQHNENAKKQTIPMTPLAFKKNLKGVNGGDDFDEQMLDEIYNTIKNDEIVMPAEQTGLVRENYLWKVLLRKGASKEGVYLHIPQGTYDSELFKLIYGPVVTALCAVYEKSEDSGIFKRIMLGFEKCAFVAAHFNMTENLDTLILSLCKYTVFFNQKRQNNIAISFGSNQKAQLALKTVFSLVHLHGDNIRDSWKHIFDLILALYSNNLLPKSYIEVEDFIDPSGRIVLSYKEIENLQKQDTSLLSSLYSYMVSAENLSKVPSPEEQQFIAIAKECLKDCNLDQLITDSKFLHEEALLELAKALIELSRGPDGQRSVEYGYNESETVFFMELLFKIVIQNRDRVMTVWQPVRDHIYTLMMNASLFDYQFLLERSVIGLLRIAIRLMRNEDMCPIVIQSLRMLLLLKGTTLCRISKQISFGLYELLKTSAQNIHTTTDWTIIFTLLECVGAGAQPPKPIVDDGVSHVDPGTKSEGENQINSDDESIVSDRGYTSDTELTKAARTNQRAPSPILVPNSPIGTPNTGGWILVGNEGEIQPVIGR

SEQ ID NO: 10892 - protein, 205 aa, Sitophilus oryzae
MSILAYNGGAMVAMKGENCVSIAADRRFGIQAQTVATNFEKIFEMGPQLYVGLPGLATDTQTVMEKLRFRKNLYELKENRSISPKVFSAMVSHMLYEKRFGPFFVEPVIAGLDPKTYEPFICNMDLIGCINQPKDFVVGGTASAQLYGMCEALWEPNLGPDDLFEITSQALINAFDRDAMSGWGATVYIIEKDKVTIRNLKTRMD

SEQ ID NO: 10893 - protein, 636 aa, Sitophilus oryzae
MEYCRLFTELAESFLDKIVSSSAPNNMHHSVKILDLVLMCVGHHDYEVAEITFNLWYLLSEQLYQLSNNNISDLFRPYIERLITALCRHCQMEPDCEGILEDGDEFKDFRIKVSELIRDVAFIVGSTSCFRQMFLNLQNPGVTWDQTEAALYIMRAVGKYVLSSENEVVPNVIEAIINIPETTHIAVRYTSVLLLGELCEWIESHSQVLDPVLNFLIHALAQPGLGAAAANALQNICATCSDNLSRHVPILLQLLHQIDTFGISDEAVVGLFKGVSTIIALMPLNEITPAMRELCLMQVNPLCHLIDQNVSPTKGTKTDPVMWFDRLSSILRHVIVNNIPEGEVHPCKPVILEIWPVLSRAFDKYQNDIRIMERCCRSVRFMLRCASHQIHEVLETLVGQIVRIYSVHKHSCFLYVGSILVDEYATDPRCIGGLIDMLQMFIEPTFQMLQEEHGLRNHPDTVDDFFRLCGRFIRRAPMSFLQCSALVPIIQCALLASQLDHKEANVSVMKFFCDLINQGQTGQSQPDYAERHKLVKDILDQFGQQLVTSLLQACVFYLQMYLLPEVSDVFVQLLDFNRTTTSKWLMNGLDTLPKRNNGGIMAATPEQLNDLHVTFIRATSSRSVTYVLKDLIRYYR

SEQ ID NO: 10894 - protein, 501 aa, Sitophilus oryzae
  misc_feature (407)..(407): Xaa can be any naturally occurring amino acid
MAQRFPGPGAAPVPSAPPPQRYQQPQNPGMRQYNQQNFPQRAGYNNPPPNMNTSGGTMIQRPSGAPYSPMRGAQIPTQPTGKRPADNRSTIQQKSDYSHSTSKKKKKLADKILPQKVRDLVPESQAYMDLLAFERKLDATIMRKRLDIQEALKRPMKQKRKLRIFISNTFYPAKEPCPDSPDGSAQEGSVASWELRVEGRLLDDAKNDPNKVKRKFSSFFKSLVIELDKELYGPDNHLVEWHRTLTTQETDGFQVKRPGDKNVRCTILLLLDYQPLQFKLDPRLARLLGVHTQTRPVIISALWQYIKTHKLQDSHEREYIVCDKYLEQIFNCSKMKFAEIPQRLNPLLHPPDPIVINHVISVEGGAESKQTACYDIDVEVDDTLKTQMNNFLLSTASQQEIQGLDSXSKIHETVDTINQLKTNREFFLSFAKDPQQFIHKWIVSQTRDLKTMTDVVGNPEEERRSDFFYQPWAQEAVCRYFYTKVQQKRAELEQALGIRNN

SEQ ID NO: 10895 - protein, 144 aa, Sitophilus oryzae
MPKVRRSKKAPPEGWELIEPTLDELEQKMREAETESHEGKRKNESLWPIFKIHHQKSRYIYDLFYRRKAISRELYEYCLNENIADKNLIAKWKKQGYENLCCLRCIQTRDTNFGTNCICRVPKGKLEEGRIVECVHCGCRGCSG

SEQ ID NO: 10896 - protein, 304 aa, Sitophilus oryzae
  misc_feature (226)..(226): Xaa can be any naturally occurring amino acid
MPTATVGSLQLPNNEDCGIRDVWAHNLEDEFRTIRQIVQKYQYVAMDTEFPGVVARPIGEFRSSADYQYQMLRCNVDLLRIIQLGLTFLDDNGKTPGGSYTTWQFNFKFNLQEDMYAQDSIDLLTNSGIQFKKHEDEGIEPLEFAELLMSSGIVLMDNIKWLSFHSGYDFGYLIKLLTDNNLPQDENEFFDLLKLYFPTIYDVKYLMKSCKTLKGGLQEVAEQLEXGLQEVAEQLELERVGPQHQAGSDSLLTGMAFFKMKEMFFEDTIDDSKFSGHLYGLGTSFAVNGTNNYPPDNGDNANSA

SEQ ID NO: 10897 - protein, 403 aa, Sitophilus oryzae
MSEAGKSRNNIYEDLSNVEFETSEDVDVIDKFSKMNLKEELTRGIYAYGFEKPSAIQQRAIKPIIKGRDVIAQAQSGTGKTATFSISILQTLDLTVRETQVLCLSPTRELAVQIQKVILALGDFMNVQCHACIGGTNLGEDIRKLDYGQHVVSGTPGRVYDMIRRRALRTRSVRMLVLDEADEMLNKGFKEQIYDVYRFLPPSTQVVLISATLPHEILEITSKFMTDPIRILVKRDELTLEGIKQFFVAVEREEWKFDTLCDLYDTLTITQAVIFCNTKRKVDWLTEKMRESNFTVSCMHGDMPQKERDNIMKEFRSGQSRVLITTDVWARGIDVQQVSLVINYDLPNNRELYIHRIGRSGRFGRKGVAINFVKSDDIRILRDIEQYYSTQIDEMPMNVADLI

SEQ ID NO: 10898 - protein, 535 aa, Sitophilus oryzae
MTAPKASGDANRNNRNAAYKDKSKPTDVRTSNINAAKAVCDAIRTSLGPRGMDKMIQASNGEVTITNDGATILKQMNVIHPAAKMLVELSRAQDVEAGDGTTSVVVIAGALLDTAEKLLNRGIHPTAISESFQKAASHAVEILNNIATPVELNNREQLIKSASTSLNSKVVSQQSTQLAPLAVDAVLKVLEPGRESACNLTDIKVLKQLGGTVEDTELINGLVFPRTLANVVGPKRLEKVKIGLIQFCISPPKTDMDHNVIVSDYAAMDRVLKEERAYILNIVKQVKKAGCNVLLVQKSILRDAISDLALHFLDKIKCMVVKDIEREDIEFVCKTLGCRPIASLDHFVAENLVSADLAEEVGFGANRMVKISGIQNPGRTITLLVRGSNKLVLEEAERSLHDALCVVRCLVRKRAVIAGGGAPETELALRLAALADKMEGVDAICLRAYAGALEIIPFTLAENAGLNPIQTVTELRNRHAKGEISAGINVRKGCISDILEENVIQPLLVTTSALSFATETVRSILKIDDIVNTMT

SEQ ID NO: 10899 - protein, 445 aa, Sitophilus oryzae
MEAMDVVLPEKEEGSPSDTTKPNLQDLDTEDLYTKYKKLQQMLEFLEVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVSYSDIGGMDMQKQEIREAVELPLTHFELYKQIGIDPPRGVLMYGPPGCGKTMLAKAVAHHTTAAFIRVVGSEFVQKYLGGKTMLAKAVAHHTTAAFIRVVGSEFVQKYLGEGPRMVRDVFRLAKENSPAIIFIDEIDAIATKRFDAQTGADREVQRILLELLNQMDGFDQTTNVKVIMATNRADTLDPALLRPGRLDRKIEFPLPDRRQKRLVFSTITSRMNLSEEVDLEDYVARPDKISGADINAICQEAGMHAVRENRYIVLPKDFEKGYKNNIKKDESEHEFYKNNIK

SEQ ID NO: 10900 - protein, 194 aa, Sitophilus oryzae
  misc_feature (127)..(127): Xaa can be any naturally occurring amino acid
MPKIKLQSSDGEIFDVEVETAKCSVTIKTMLEDLGMDDEEEEIVPLPNVNSAILRKVLQWATFHKDDPPPPEDDESKEKRTDDISSWDADFLKVDQGTLFELILAANYLDIKGLLDVTCKTVANMIXQGTLFELILAANYLDIKGLLDVTCKTVANMIKGKAPDEIRKTFNIKNDFTASEEDQVRKENEWCEEK

SEQ ID NO: 10901 - protein, 344 aa, Sitophilus oryzae
MKATTSPKLNKLFISKQNEFQDIQSKAEQGLINMAIDEKASCKELDQWIEQLNDCNQLTENQVKTLCDKAKEILSKESNVQEVKCPVTVCGDVHGQFHDLMELFRIGGRSPDTNYLFMGDYVDRGYYSVETVTLLVALKVRYKERITILRGNHESRQITQVYGFYDECLRKYGNANVWKFFTDLFDYLPLTALVDGQIFCLHGGLSPSIDTLDHIRALDRLQEVPHEGPMCDLLWSDPDDRGGWGISPRGAGYTFGQDISETFNHSNGLTLVSRAHQLVMEGYNWCHDRNVVTIFSAPNYCYRCGNQAAIMELDDALKYSFLQFDPAPRRGEPHVTRRTPDYFL

SEQ ID NO: 10902 - protein, 1293 aa, Sitophilus oryzae
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEASDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEASDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYSIQKESTLHLVLRLRGGN

SEQ ID NO: 10903 - protein, 559 aa, Sitophilus oryzae
  misc_feature (195)..(195): Xaa can be any naturally occurring amino acid
MMQPQILLLKEGTDTSQGKPQLISNINACQSIVDAVRTTLGPRGMDKLIVVRSGKATISNDGATIMKLLDVVHPAAKTLVDIAKSQDAEVGDGTTSVVLLAGEFLKHIKPYVEEGVHPRIIIKAVRKSLQLCLEKIQEISVKINKSNALEFRSLLEKCASTAMSSKLISQQRAFFSKMVVDAVLLLDDLMPLNMXSKMVVDAVLLLDDLMPLNMIGIKKVQGGGLEDSTLVAGVAFKKTFSYAGFEMQPKVYKNCKIALLNIELELKAERDNAEVRVDSVKEYQKIVDAEWNILYNKLKKIHESGANVVLSKLPIGDVATQYFADRDMFCAGRVAEEDLRRTLKACGGAVMTTVNDLNDSVLGNCDLFEERQIGGERYNFFRGCPNAKTCTIILRGGAEQFLEETERSLHDAIMIVRRTIKNDAVVAGGGAIEMELSKILRDYSRTIAGKEQLLISAVAKALEIIPRQLCDNAGFDATNILNKLRQKHAQGHCWYGVDVSKEDISDNFESCVWEPAIIKINALTAATEAACLILSVDETIKNQKSAEPPQMGRGMGRPM

SEQ ID NO: 10904 - protein, 2063 aa, Sitophilus oryzae
MEWCDKYQAQIVVLAAQIFWSEDVEAALSKMNGEPQKGPLEKVLQQVENTLNVLADSVLQEQPQLRRKKLEHLINEFVHKRTVTRKLIVSGVCSNKAFEWLCQMRFYFDPRQTEVLKQLTIHMANARFYYGFEYLGVQDRLVQTPLTDRCYLTMTQALEARLGGSPFGPAGTGKTESVKALGNQLGRFVLVFNCDETFDFQAMGRIFVGLCQVGAWGCFDEFNRLEERMLSAVSQQIQTIQEALKSQKESSDSQGQQGGSISVELVGKQVRVSPDMAIFITMNPGYAGRSNLPDNLKKLFRSLAMTTPDRQLIAEVMLFSQGFRSAEKLACKIVPFFKLCDEQLSNQSHYDFGLRALKSVLISAGNVKRDRIQRIKENMKQRGETNIDEASIAENLPEQEILIQSVCETMVPKLVAEDIPLLFSLLNDVFPNVQYTRAEMKGLKDEIRKVCAEEYLVCGEGDEQGSAWMEKVLQLYQICNLNHGLMMVGPSGSGKSSAWRVLLKALERFEGVEGVAHVIDPKAISKEALYGVLDPNTREWTDGLFTHILRKIIDNVRGEINKRQWIIFDGDVDPEWVENLNSVLDDNKLLTLPNGERLSLPPNVRVMFEVQDLKYATLATVSRCGMVWFSEDVLTTEMIFENYMLRLKHIPLEEGEDDSFGKKIENKEDTVSPTLQVQQDVANLLQPFLQPDGLVIRCLEHSMEQEHIMDFTRLRALSSLFSMLNQSVRNVLQYNHSHNDFPLAFETLERYIPKCLIYAILWSFAGDAKLKVRSELGDFVRSITTVPLPPDNNTPIIDYEVTIEGEWAPWSNKVPQIEVETHKVASPDIVVPTLDTVRHESLLYTWLAEHKPLVLCGPPGSGKTMTLFSALRALPDMEVVGLNFSSATTPELLLKTFDHYCEYRKTPNGVVLSPVQLGKWLVLFCDEINLPDMDNYGTQRVIMFLRQIVEQKGFYRASDQTWVSLERIQFVGACNPPTDPGRKPLSHRFLRHVPVIYVDYPGETSLKQIYGTFTRAMLRLTPGLKGYAEPLTNAMVEFYLASQDRFTQDMQPHYVYSPREMTRWVRGICEAIRPLDSLSVEGLVRLWAHEALRLFQDRLVEDSERQWTNENIDSVALKHFPSANCERALERPILYSNWLSKDYTPVEREKLREYVKARLKVFYEEELDVPLVLFDEVLDHVLRIDRIFRQPQGHLLLIGVSGAGKTTLSRFVAWMNGLSIFQIKVHNKYTAEDFDEDLRSVLRRSGCKDEKIAFILDESNMLDSSFLERMNTLLANGEVPGLFEGDEYTTLMTQCKEGAQREGLMLDSSDELYKWFTQQVMRNLHVVFTMNPSTDGLKDRAATSPALFNRCVLNWFGDWSDGALFQVGKEFTYRLDLDRPTWKSPDFFPAACKFVPTSPNHREAVINACVYVHQTLHKANVRLAKRGGRTMAITPRHYLDFIHHFVKLHNEKRSDLEEQQLHLNVGLNKIAETVEQVEEMQKSLAVKSQELQAKNEAANAKLKQMVKDQQEAEKKKVQSQEIQQQLAEQTVHIEQKRTEVMADLAQVEPAVIDAQTAVKSIKKQQLVEIRSMSNPPAIVKLALESICLLLGENASDWKSIRSVIMRDNFINTVVNNFNTEDISDDVRDKMKSKYLSNPDYNFEKVNHASNACGPLVKWAMAQIQYADMLKKVEPLRQELSSLETQAETNKKRGEEVKNLISQLEHSIASYKDEYAQLIAQAQAIKTDLENVQAKVDRSIALLKSLVIERERWEATSETFRAQMSTIVGDVLLSAAFIAYGGYFDQHYRQNLFMAWCQHLTQASIQYRPDIARTEYLSNPDERLRWQANALPSDDLCTENAIMLKRFNRYPLIIDPSGQATDFIMNEYKDKKITKTSFLDDSFRKNLESALRFGNPLLVQDVENYDAILNPVLNRELRRTGGRVLITLGDQDIDLSPSFIIFLSTRDPTVEFPPDICSRVTFVNFTVTRSSLQSQCLNQVLKAERPDIDAKRSDLLKLQGEFHLRLRQLEKSLLQALNDAKGKILDDDSVITTLETLKKEAAEIGQKVEETDKVISEIEAVSQQ

SEQ ID NO: 10905 - protein, 668 aa, Sitophilus oryzae
MPGSRDKIKKEPELTEQEKKKLTIEETKISLPIFPFKEDLIQAVQEHQVLIIEGETGSGKTTQIPQYLHEAGFTNDNKKIGCTQPRRVAAMSVAARVAQEMGVKLGNEVGYAIRFEDCTSERTIIKYMTDGTLHREFLSEPDLQSYSVMIIDEAHERTLHTDILFGLVKDIARFRPDLKLLISSATLDAQKFSEFFDDAPIFRIPGRRFPVDIYYTKAPEADYVDACVISILQIHVTQPLGDILVFLTGQEEIETCQELLQDRLRRLGSKVKELIVLPVYANLPSDMQAKIFDPTPPGARKVVLATNIAETSLTIDNIIYVIDPGFAKQNYFNSRTGMESLMVVPISKASANQRAGRAGRVAAGKCFRLYTAWSYKHELEDNTVPEIQRINLGNAVLMLKALGINDLVHFDFLDPPPHETLVLALEQLYALGALNHHGELTKMGRRMAEFPVDPMMAKTLLASEKYKCSEEVVTITAMLSVNSAIFYRPKDKIIHADTARKNFNHVAGDHLSLLNVYNQWRDTDFSTQWCYENFIQYRSMKRARDVREQLVGLMQRVEIEMVSNISETVDIRKAITAGYFYHIARFSKGGNYKTVKHNQTVTIHPNSSLFDELPRWILYHQLVFTTKEFMRQVIEIESKWLLEVAPHYYKPKELEDSTNKKMPKTIGR

SEQ ID NO: 10906 - protein, 456 aa, Sitophilus oryzae
MKVEEVKSTVKTQRISAHSHIKGLGLDENGFAIQQAAGLVGQEQAREAAGVVVDMIRSKKMAGRAVLLAGPPGTGKTAIALAIAQELGNKVPFCPMVGSEVYSSEIKKTEVLMENFRRAIGLRIRETKEVYEGEVSELTPVETENPAGGYGKTVSHVVIGLRTAKGSKQLKLDPSIYEALQKEKVEVGDVIYIEATSGAVKRQGRSDAYATEFDLEAEEYVPLPKGDVHKKKEVVQDVTLHDLDAANAKPQGGQDVLSMMGQLLKPKKTEITDKLRKEINKIVDKYIDQGIAELVPGVLFIDEVHMLDIETFTYLHRALESAIAPIVIFATNRGRCLIRGTDDIFSPHGIPLDLLDRLLIIRTVPYDRPDMEQILKLRAKTEGLEIDEEAITTLGEVGVKATLRYVVQLLTPAHLTAKINGRTNITQSDVEEVASLFLDAKQSAKILSENKEKFMN

SEQ ID NO: 10907 - protein, 731 aa, Sitophilus oryzae
MTSIIKLQVLSGAMDESPPAYLLQVDDVKILLDCGWDEKFNMEFIKEVKRHIHQIDAVLISYPDPSHLGALPYLVGKLGLNCPIYSTIPVYKMGQMFMYDLYQSQYNMKDFFLFNLDDVDATFDKIIQLKYNQSVPLKGKGYGLTITPLPAGHMIGGTIWKIMKAGEEDIIYANSFNHKKERHLNGCELEKLQRPSLLIIDAFNATYQQARRRARDEKLMTNILQTLRNNGNVLIAVDTAGRVLELAHMLDQLWRNKESGLLTYSLALISNVAYNVVEFAKSQIEWMSDKLMRSFEGARNNPFQFKHLYLCHTLSELNKVASPKVVLASSADLESGFSRELFLQWCSNSNNSVIITTRTCPGTLARDLIDNNEKGRTIDMIVERRVKLEGAELEEFEKRQQQRTHISNGTKDDVDSDSDSDIEMSVISKGRHDIVIKQEGKVSGGFFKVTKKQYPMYPFREDKIKCDEYGEIVKIEDYRLADVNPEAEDNKENLEVKREEEEEEIIEILEVPSKCIALERTVQVNCQVQYIDFEGRSDGESLMKILSQLRPRRVIVVHGTEDNTEVIAAHCRDNIRARVFTPQRGETVDATSETHIYQVRLTDSLVSQLDFKKAAKDAEVAFINAQIALREIQADAKRMTTDNEPMEVDDDDQKILTLEPHTAEAHHEPVFINELKLSDFKQVLAKANVSSEFSGGVLWCCNGTIAVRKLDTGKIVFEGCISEDYYKVKDL

SEQ ID NO: 10908 - protein, 760 aa, Sitophilus oryzae
  misc_feature (666)..(666): Xaa can be any naturally occurring amino acid
MPPLEVANAATEESAPTNPVVGIIYPPPEVRNIVDKTASFVARNGPEFEARIRQNELGNPKFNFLNTGDPYHAYYQHKVNEFKEGKGQEPTISHGVSKLTVSASAQQKQHEILKQVEQPFVPKDPPSEFEFIADPPSISALDLDIVKLTAQFVARNGRAFLTQLMNREQRNFQFDFLRPQHSLFQYFTKLLEQYTKVLIPPKTMQQKLKEEVKSTKTVLEQVKYRAEWQKYQEAQKAKEEEILERERIAYAQIDWHDFVVVETVDYQPFEIGNFPPPTTPEEVGARILIQERLEDGDDIEMQLESDEEDGGQEDQSLSYMEDRTNTNRKDARDNNQVQDMDEESSDDEDQDKRSDQPSIQPPLPPVPDKVLVKKYDPKQAPKVTRPTVGDDYLVSPITGEKIPASKVQEHMRIGLLDPRWVEQRDKHVTDKMNQDTVYAQGTAIEASLKLLAERRTDIFGVGDEETAIGKKIGEEDIRKDEKVTWDGHTSSVEAATRAARANITLEEQIHQIHKVKGLLPDEEKEKIGPKNVTGGSKMKGTGQMIKPPPPPQLQAPKATIVTVPPQPILAPQPPIMMMAAPPMPPMRPSLMVPTHPPMAGFVTPLPPPPMGPPVTMPMKHPSEVQLDDEPSNKKMRNEDSLVPEEVFLARNPSPVMVKVTIPMMPXRNPSPVMVKVTIPMMPEKSEWKLSGQVLNFTLPLGESVANLKAKIQEEISMPPAKQKLFFDGMFFKDSNTLAYYNITPAAVIQLQVKERGGRKK

SEQ ID NO: 10909 - protein, 321 aa, Sitophilus oryzae
MPSQEVTTSKVVVHPLVLLSVVDHFNRMGKIGNQKRVVGVLLGCWRAKGVLDVSNSFAVPFDEDERDKSVWFLDHDYLENMYGMFKKVNARERVVGWYHTGPKLHQNDIAINELVRRYCPNSVLVIIDAKPKDLGLPTEAYQAVEEVHDDGSPTSKTFEHVPSEIGAEEAEEVGVEHLLRDIKDTTVGTLSQRITNQLLGLKGLYSQLRDIRDYLIQVSEEKLPINHQVIYQLQDIFNLLPDINQMQFNKSFYVKNNDQMLVVYLAALVRSIVALHNLINNKLTNRDAEEGKKEDKKDKEKEKDNKKEEKKKRTKKIKKRK

SEQ ID NO: 10910 - protein, 560 aa, Sitophilus oryzae
  misc_feature (224)..(224): Xaa can be any naturally occurring amino acid
MFGGGRAPILVLSQNTKRESGRKVQLENINAGKQVADVIRTCLGPQAMLKMLMDPMGGIVMTNDGNAILREITVQHPAAKSMIEIARTQDEEVGDGTTSVIVLAGEMLASAEQFLEQQIHPTVIIKQYRQALEDIIALLEGPLSVSIDKNDKKALANVVKGCIGTKFISKWSDLAVNIALDAVQTVMLEENGRTEVDIKRYAKVEKIPGGSLEDSEILKGVMLXDSEILKGVMLNKDVTHPKMRRYIENPKIILLDCSLEYKKGESQTNVEITAEGDFTRMLEIEEEHVRKQCDDIIALKPDVVFTEKGVSDLAQHFLLKAGISAVRRVRKSDNNRIARACGAVIVNRTEELQASDIGTGAGLFEIKKLGDEYFCYITKCKNPKACTIVLRGASKDILNETERNLQDALQVARNIVLKPRLVPGGGAIEMAVAQRLLQKATHGPYRALAHALEIIPRTLSQNCGANTIRTLTALRAKHANHTDQNSPCTWGIDGESGELVEQKDKGIWEPLAVKLQTYKTAIETAILLLRIDDIVSGSKKKDKEPNTPSQIQEQTAAMQD

SEQ ID NO: 10911 - protein, 232 aa, Sitophilus oryzae
MSLAIRPYYPDYSTVPTQHHFNPYADNGGSIVAIAGNDFVIIGADTRLSAGFSIYTREQNKLFSLSGTTVLGCSGCWCDTLTLTRILKSRMQMYQQEHNKVMSTEACAQMLSTMLYYKRFFPYYISNVLVGLDNEGKGCVYSYDPIGHCEKATYRAGGSAGALLQPLLDNQIGQKNMLNVKPESVTKERALSIIKDVFISAAERDIYTGDSISINIITKDGITQETFELRKD

SEQ ID NO: 10912 - protein, 324 aa, Sitophilus oryzae
MSRRPRTRQSTRRVFMEGADSIGGNAAFQFGFNMFPDIPRPFNVTYHCYSVAMLPGNERQDVERGGKIIMPPSALEQLTRLNINYPMLFKLTNKTTSRVTHCGVLEFVADEGKVYLPLWMMHNMTLEEGDLVQMESVSLPVGTFSKFQPLSPEFLDITNPKAVLENCLRSFACLTTGDVIAVQYNQKVYELCVLETKPGDAISIIECDMNVEFAAPVGYKEPEIERKIEDEEMAVDPSDLMPEPSGFVAFKGAGNRLDGKKRKDSVTTDAVPKSTYVRGIPDYDYQIGTLKFIRRSVKQKGNDTEDNNEFKAFSGAGFSLRGRN

SEQ ID NO: 10913 - protein, 560 aa, Sitophilus oryzae
  misc_feature (213)..(213): Xaa can be any naturally occurring amino acid
MSAFPGSIAFDEYGRPFIILRDQDQQRRLTGIDALKSHILAARQIANTIRTSLGPKGLDKMMISPDGDVTVTNDGATILKLMDVEHEVGKLLVELSQSQDDEIGDGTTGVVVLAGALLEQAATLLDRGIHPIRIADGFEMACQTAVSHLEKIAELFPVSDKNPEPLIKVAMTTLGSKIINKCHRQMAEIAVNAVLAVADLEQKDVNFELIKVXAVADLEQKDVNFELIKVEGKVGGKLEDTVLVKGVVIDKTMSHPQMPKELKNVKLAILTCPFEPPKPKTKHKLDVTDVAGYKELRQYEQDKFKEIVGLVKKAGATLAICQWGFDDEANHLLLQQQLPAVRWVGGPEIELIAIATGGRIVPRFEELSPEKLGSAGLVREISFGTTSDKMLIIEECSNSRAVTILVRGGNKMLVEEAKRSLHDALCVVRSLVQEPRVVYGGGAAEIACSLAVAAQADQLASLEQYAYRAFAEALEAIPLALAENSGLSAIHALGEVKAKQASSGDPALGIDCMFTGNLNMREQHVIESLRSKRQQLLLATQLVKMILKIDDVRSPGNREE

SEQ ID NO: 10914 - protein, 113 aa, Sitophilus oryzae
MASAMDVDVDEVEMPTSSSSKGDRKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 10915 - protein, 534 aa, Sitophilus oryzae
MVSLNAVRILRENAEEEKAEIARLSSFVGAIAIGDLVKSTLGPKGMDKILVSSGRNAGSVEVTNDGATILKSVGIDNPAAKVLVDMSKVQDDEVGDGTTSVTVLASELLREAEKLIDQKLHPQIIIAGWRKAVDIARKALTDASQDNSANSDTFREDLLNIARTTLSSKILSQHKEHFAKLAVDAVLRLKGSGNLQAIQIIKKSGGTLEESFLEEGFLLDKKPGVHQPGRVENAKILIANTPMDTDKIKVFGSTIKVDSMAKIAELESAEKEKMKDKVAKILKHNCTVFINRQLIYNYPEQLFADAGVMAIEHADFDGIERLALVTGGEIVSTFDQPESVKLGTCDLIEQIMIGEDTLLRFSGVALGEACSIVIRGATQQIIEEADRSLHDALCVLAATVKESRIVYGGGCSETLMAVAVSKAALSTAGKEAVAMEAFARALLQLPTIIADNAGYDSAQLVTELRAAHTSGQFTMGLNMDKGEIGDMRTLGITESFAVKRQVLVSASEAAEMILRVDNIIRAAPRKRVEDRGHC

SEQ ID NO: 10916 - protein, 315 aa, Sitophilus oryzae
MFRNQYDSDVTVWSPQGRLHQVEYAMEAVNLGSATVGLKSNAYAVLIALKRASSELSAYQKKVINIDDHIGVTISGLTADARILSRYMRTECLNYKYSHDTYLPLNRLITTLGNKMQVCTQRYDRRPYGVKYSHDTYLPLNRLITTLGNKMQVCTQRYDRRPYGVGLLVAGYDDKGTHIYQTCPSANYYDCKAMSIGSRSQSARTYLEKHLDQFSNSSLEELIKHGLRALRDTLPPEVDLSTKNVSIGYVGKEQQFKILDEEETAPYLRLIEGEERRGATSEKPQGPLRDDQGDEPRDPMPDVAIEAAEHAMDTD

SEQ ID NO: 10917 - protein, 854 aa, Sitophilus oryzae
MPMKEANKDVPMDIVFTEEDLPYEEEILRNPYSVKHWLRYIEHKKKAPKHGVNLIYERALKELPGSYKLWYNYLRTRRQQVKNKCITHPGYEEVNNAFERSLVFMHKMPRIWMDYCTFLTDQFKITRTRKVFDRALRALPVTQHHRIWPLYLGFVKKHDISETAVRVFRRYLKLSPENAEEYVDYLNSVGRLDEAAITLGKIVNDENFVSQYGKSKHQLWNELCELISNNPDKVQSLNVDAIIRGGLRRYTDQLGHLWNSLANYYVRSGLFDRARDIYEEAIQTVTTVRDFTQVFDAYAQFEELSLSKRMEEVSKMTKPTEEENLDLDLKLARFEHLMERRLLLLNSVLLRQNPHNVQEWHKRVQLYEGKPHEIINTYTEAVQTVEPKLAVGKLHTLWVEFAKFYEKNGQVDDARIIFEKATEVPFIKVDDLASVWCEWAEMEIRNENYEDALKLMHRATTMPARKVAYHDDTERVQDRLYKSLKVWSMYADLEESFGTFKSCKAVYDRIIDLRIATPQIIINYGVFLEENNYFEEAFRAYEKGISLFKWPNVYDIWNTYLSKFLKRYGGSKLERARDLFEQCLEKCPTQFAKNLYLLYAKLEEEHGMARHAMAVYERATKAVPEKEMFEVFNIYIKQAADIYGIPKTREIYKKAIEVLPDDKTREMCLRFADMETKLGEIDRARAIYDYCSQICDPRVTVEFWQTWKEFEVRHGNEDTMREMLRIKRSVQAMYNTQVNMMSAQMLSSAGSLTGTTADLAPGEKDGMRLLEAKAAEMAGAGTSGISSRPGNIMFVRGETQGDKKDKVVNPDEIDIDDDDEEEEDEVEVPLEKQAVPSEVFGSLKKNSTEDDNDD

SEQ ID NO: 10918 - protein, 401 aa, Sitophilus oryzae
MANGPIAERNRDATIYVGGLDDKVSESLLWELFVQAGPLVNVHMPKDRVTMMHQGYGFVEFMGEEDADYAIKIMNMIKLYGKPIRVNKASAHQKNLDVGANIFIGNLDPEVDEKLLYDTFSAFGVILQTPKIMRDPETGNSKGFAFINFASFEASDASIEAMNGQYLCNRPISVSYAFKKDSKGERHGSAAERLLAAQNPLSQADRPHQLFADAPPMGMMGMAMAPPPPPVILGGLMPMPPPTAMAPPPPPVILGGLMPMPPPTPASMAPPPPPPVPPPSSFPSGIPPPPLPPSQPPLPPGAPPISAAGAGGAPRPPLPAGGMPRGMMPPPPPWQAGGMPPLPTSGQAAANSNFPNIFPPPPPPGARPPPPNWRPPPPPNFAGARPPFPPRGPPPPPPSMQ

SEQ ID NO: 10919 - protein, 257 aa, Sitophilus oryzae
MGRVIRAQRKGAGSVFKSHTKRRKGAPKLRYLDFSERHGYIKGVVKDIMHDPGRGAPLAVVHFRDPYKFKTRKELFIAPEGMYTGQFVYCGKKANLQIGNVLPVGTMPEGTIVCNLEEKTGDRGRLARASGNYATVIAHNHDTKKTRVKLPSGAKKVIPSNNRAMVGIVAGGGRIDKPILKAGRAYHKYKVKRNCWPKVRGVAMNPVEHPHGGGNHQHIGKASTVKRGTSAGRKVGLIAARRTGRIRGGKVDSKKED

SEQ ID NO: 10920 - protein, 136 aa, Sitophilus oryzae [sequence omitted]

SEQ ID NO: 10921 - protein, 545 aa, Sitophilus oryzae
  misc_feature (73)..(73): Xaa can be any naturally occurring amino acid
MAISLLNPKAEVARAAQALAVNISGAKGIQDVMKSNLGPKGTMKMLVSGAGDIKITKDGNILLHEMQIQHPTXGNILLHEMQIQHPTASLIARASTAQDDMTGDGTTSTVLLIGELLKQGDIYIAEGLHPRILTDGFDKAKTKALEVLDKIKIAIEPNKENLTDVCRTSLRTKVHQKLADVLTDVCVEAVLALKSQDKPVDLHMIELMQMQHKTETDTTLVKGLVLDHGSRHPDMPKRLENCYILTCNVSLEYEKSEVNSGFFYKTAEERDKMVAAEREFIDQRVKKIIELKKKVCAGNNKSFVVINQKGIDPMSLDQLAKEGIIALRRAKRRNMERLALACGGVAMNSFDDLSESVLGYAGVVYEHVLGENKYTFVEDCKNPQSVTILMKGPNKHSLDQIKDSIRDGLRAINNALEDKAVIPGAGAFEVMANKELMQWKDTIKGKSRLGVIAYAEALLIIPKVLATNSGFDVQETIVKLQEESRINPEPIGLDLVSGEPINPKDAGIFDNYIVKKQIINSCSVIASNLLLVDEVMRAGMSSLKG

SEQ ID NO: 10922 - protein, 1060 aa, Sitophilus oryzae
MSSADTADSSVDPPSKKRKLDTSGSIDMANNGVASGSQAQNNAAEIDEGLYSRQLYVLGHDAMRRMASSDVLISGLGGLGVEVAKNVILGGVKSVTIHDEKQVSITDFSSQFFFVPEDTGKNRAEVVCKKLSELNNYVPTRSYTGPLNEDYIKKFSVVVLTDSTRAEQLRISEVTHANNIALIVADTKGLFAQVFCDFGDSFTVVDTNGEPVVSAMIADISTDKESVVTCIDDTRHGMEDGDYVTFSEVQGMTELNGCAPKKIKVLGPYTFSIGDTTGFSKYERGGIATQVKMPKELSFKSLKESLENPEFVITDFAKFDHPSQLHLAFSTLHNYVERNKKLPKPWSSEDASQFLSIAKTLVSGDTEVNTELLDLFAKTSAGELNPINATIGGIVAQEVMKACSGKFHPILQWLYFDAIECLPSDPKDRLLITEEDAAPTGSRYDSQIAVFGKEFQKKINSLKYLIVGAGAIGCELLKNFSMMGVGSDNGQIFITDMDLIEKSNLNRQFLFRPHDVQKSKSVCAAKAAKKMNDQINVIAHENRVGPETESIYDDDFFENLDGVANALDNVDARIYMDRRCVYYRKPLLESGTLGTKGNVQVVVPFLTESYSSSQDPPEKSIPICTLKNFPNAIEHTLQWARDAFEGLFRQSAENASQYLTDPDFIERTVKLPGVQPLETLESVKAALVDDRPKSFEECIVWARKHWQDQYHNQISQLLYNFPPDQLTSTGQLFWSGPKRCPVPLTFDINDTLHLDYVIAAANLKAQVYGIPTNRDRAYIAGVASKVEVPPFVPKSGVKIAVTDSQMAANGNSIDMDRITQLRGELPPPEEVAGLVLTPLDFEKDDDSNFHMDFIVAASNLRAANYKIPPADRHKSKLIAGKIIPAIATTTSVVAGLACLELYKLARSLKSLEPFKNGFVNLALPFFGFSEPIAAPQMEYCGNKWTLWDRFEVQGEMTLAEFLQYFQDKHGLEITMLSQGVCMLYSFFMQKAKAQERLGLTMSEVVKRVSKKRIEPHVRALVFELCCNDADGNDVEVPYVKYNLGPKERDSSDCNSVNKIW

SEQ ID NO: 10923 - protein, 423 aa, Sitophilus oryzae
MAEPEDLLDYEDEEPTEQTATETTAETKKGVKGSYASIHSSGFRDFLLKPEILRAIVDCGFEHPSEVQHECIPQAVLGMDILCQAKSGMGKTAVFVLATLQQLEPTENVVYVLAMCHTRELAFQISKEYERFSKYMPNIKVGVFFGGMPIQKDEEVLKNNCPHIVVGTPGRILALVRSKKLNLKHLKHFILDECDKMLEVLDMRRDVQEIYRNTPHGKQVMMFSATLSKEIRPVCKKFMQDPMEVYVDDEAKLTLHGLQQHYVKLKENEKNKKLFELLDVLEFNQVVIFVKSVQRCVALAQLLTEQNFPAIGIHRAMDQKERLSRYEQFKDFQKRILVATNLFGRGMDIERVNIVFNYDMPEDSDTYLHRVARAGRFGTKGLAITFVSEESDAKILNEVQDRFDVNITELPDEIDLSSYIEGR

SEQ ID NO: 10924 - protein, 492 aa, Sitophilus oryzae
  misc_feature (150)..(150): Xaa can be any naturally occurring amino acid
MVLIENDVEMKNADSPPGPEAGDSKRDTDLQSLQEIREHARQIEKAVSNKENRFIMRILRCLPNTRRKLNGVVLRSLITQIYPPSEREALLAFVEEATGEIDSSQTRTRSATKSPVPEVDVYINLLILVRLIDTNKLEEASRCSQALMNXNKITSQNRRTIDHLAAKCYFYHSRVAELTNKLDSIRSFLHARLRTATLRNDFEGQAVLINCLLRNYLHYSLYDQADKLVSKCVFPETASNNEWARFLYYLGRIKAARLEYSVAHKHLVQALRKAPQNTAVGFRQTVQKLLVVVELLLGDIPERQVFRQAQMRHSLSSYFQLTQAVRMGNLQRFGEVLENFGPQFRQDHTYTLILRLRHNVIKTAIRSIGLSYSRISPQDIAKKLGLDSAEDAEFIVAKAIRDGVIEATLDPQGGYMRSKESTDIYCTKEPQMAFHQRISFCLDLHNQSVKAMRYPPKAYGKELESAEERREREQQDLELAKEMAEEDDDGFP

SEQ ID NO: 10925 - protein, 416 aa, Sitophilus oryzae
TDILPDEFVQKNLSLSFDGKRDRWSGYNPLEHTSVIEEFQKVEEAKRQLKAEKLDAENSDNDEDEDKYVDEVDMPGTKVDSKQRITVRNLRIREDTAKYLRNLDPNSAYYDPKTRSMRENPNPGKDDTYKGENFVRFSGATKSHATAQLFAWEAYEKGVDVHLLAEPTKLELLQKEYDKKKEQFKTKVQSNILEKYGGEEHLEAPPKTLLLAQTEDYVEYSRSGKIMKGQEKEEIRSKYEEDIYINNHTSVWGSYWKGGQWGYKCCHSFIKNSYCLGESGKSTNNDTELKNSSDANINQSECINNTSETTQESELTCDKESDDSSEDDIRTKSEKKKKKNKHKKKKHKEKKAEKDKLSEALKAEEQHQKQADYLLSLDERKRPYNSMFEAKKPTEEEIEAYYLKRKREEDPMSQFL

SEQ ID NO: 10926 - protein, 209 aa, Sitophilus oryzae
MGISRDHWHKRRATGGKRKPLRKKRKFELGRPAANTKLGASRRVHYVRTRGGNLKYRALRLTHGNWAWGSESITRESRIIDVVYNASNNELVRTKTLVKNAIVVVDATPFRQWYEGHYILPLGRKKGAKLTAEEDAAFNKKRSKKIQKKYETRQKTAKVEPAIEEQFHTGRLLACISSRPGQCGRASGYILEGKELEFYLRKIKSKKAK

SEQ ID NO: 10927 - protein, 333 aa, Sitophilus oryzae
  misc_feature (270)..(270): Xaa can be any naturally occurring amino acid
MDRLLRLGGGMPGLSQAPPPSDAPVVDTAEQVYISSLALLKMLKHGRAGVPMEVMGLMLGEFVDDYTVRVIDVFAMPQTGTGVSVEAVDPVFQAKMLDMLRQTGRPEMVVGWYHSHPGFGCWLSGVDINTQQSFEALSERAVAVVVDPIQSVKGKVVIDAFRLINPNMMVLGQEPRQTTSNLGHLQKPSVQALIHGLNRHYYSISINYRKNELEQKMLLNLHKKSWMDGLTLADYSENCTTNEKTVADMLELAKNYNKALEEEEKMTPEXMLELAKNYNKALEEEEKMTPEQLAIKNVGKQDPKRHLEEKVDVLMTNNIVQCLGAMLDTVVFK

SEQ ID NO: 10928 - protein, 418 aa, Sitophilus oryzae
MTVINKMEIDGGPKGEGFRSYYITKIEELQLVVAEKSQNLRRLQAQRNELNAKVRMLREELMLLQEQGSYVGEVVKPMDKKKVLVKVHPEGKFVVDIDKNIDINDVTPNCRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGVRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 10929 - protein, 184 aa, Sitophilus oryzae
MVKLYCLSILYKGTTAATWLKSAFDLQSVSFFQRGSVHEFMQFCCKTVVERTLPASRQSVQQGDYFCHVYVRSDNLAGVVISDHEYPQRVSHTLLTKILDEFSEKIPASNWPNLQEKDVAFPQLNTYLAKYQNPREADALTKIQNELDETKIILHSNIQAVLERGEKLDDLVAKSEVLSTQSKA

SEQ ID NO: 10930 - protein, 264 aa, Sitophilus oryzae
  misc_feature (217)..(217): Xaa can be any naturally occurring amino acid
MFLTRSEYDRGVNTFSPEGRLFQVEYAIEAIKLGSTAIGISTSEGVVLAVEKRITSPLMEPTTIEKIVEVDKHIGCAFSGLMADSRTMIDRARVECQNHWFVYNENMSVESCAQAVSNLAIQFGDSDDDGAAMSRPFGVAILFAGIDEKGPQLYHMDPSGTFVQFDAKAIGSGSEGAQQSLQEVYHRSMTLEEATTAALTILKQVMEEKLNSSNVEXNSSNVEVMTMTPKNLFHMFTKEQVEEALTNVFPAEHPTPIKVNKQKV

SEQ ID NO: 10931 - protein, 367 aa, Sitophilus oryzae
MTEYWLISAPGDKTCQQTWETMNNLTAKQNSLCVNYKFQIPDLKVGTLDQLVGLSDDLGKLDGFVEQVTRKVASYLGEVLEDQRDKLQENLTANNTDLPSYLTRFQWDIAKYPIKQSLRNIADIISKQVGQIDADLKTKSTAYNNLKGSLQSLEKKQTGSLLTRNLADLVKKEHFILDSDYLQTLLVIVPKASFADWNATYEKITDMIVPRSSQLITQDNEYGLYTVTLFKKVIDEFKHHARERKFIVRDFTYDEEQLAAGKSEITKLTTDKKKQFGPLVRWLKVNFSECFCAWIHVKALRVFVESVLRYGLPVNFQAILIHPNKKTMKRLRDVLNQLYGHLDGSVGHQGSHVDNVDIPGLGFGQSE

SEQ ID NO: 10932 - protein, 557 aa, Sitophilus oryzae
MSILASPLSVAGQRQSGASVRTQNVMAAASIANIVKSSLGPVGLDKMLVDDIGDVTVTNDGATILRLLEVEHPAARVLVELAQLQDEEVGDGTTSVVIIAAELLKNADELVKHKIHPTSIISGYRLACKEACRYIQDHLTIPVEELGKDCIVNVAKTSMSSKIIGADADFFSAMVVDAAYAVKITDVRGNPMYPIKAVNILKAHGCSARESILVQGYALNCTVASQAMPKKIVGAKIACLDFSLQKAKMKMGVQVLINDPEKLEGIRARELDITKERIQKILSTGVNVILTSGGIDDLCLKYFVEAGAMGVRRVKKVDLKRIAKATGATFLTSLSNMDGDESFDASMVGEAAEVYQERVSDDELIIIKTPKQRTAASIILRGPNDFYCDEMERSVHDALCVVKRVLESKTVVVGGGAVEAALSIYLENFATTLSSREQLAIAEFAKSLLVIPKTLAVNAAKDATDLVAKLRAYHNSSQTKVEHAHLKHVGLDLIEGTVKDNKKAGVLEPTISKIKSLKFATEAAITILRIDDMIKLDAQEKGGKNYRQAMESGELYN

SEQ ID NO: 10933 - protein, 278 aa, Sitophilus oryzae
MIRRPPRSTLFPYTTLFRSKISKMFSAPPFWENGPAPGSFYNFPNLQPQVQQPQDFRQHSQSPVTTSTSLVGITYDKGILVAGDLLASYGSLARYRNCPRIVKINENIILGASGDYADFQYVKDFVEQKVISEECLDDGLALKPKSLYCWLTRILYNRRSKMDPLWNNFIVAGIQDGQPFLGTVDKHGTAYADKVICTGYGAHIATPLLRDSLDKNPQLNLAEAKALIEKCLEVLYYRDARSYPKYQLGIIDVEQGVSIEGPLEVPQKWEIAYHSKRF

SEQ ID NO: 10934 - protein, 695 aa, Sitophilus oryzae
MEQLKEPSSQLFGDPEFVAEKYVRDTSQNYVGGSELQNIKKKIQALADETSSSLKRNVYQNYVQFIETAKEISHLESEMYQLSHLLSEQKSLLNALSATSILEDGTHVNVETNNKLSEQEVEEENKQKLSMILEKVENCKDLLEVPGRTLLFEGDLLEIDPTESTALKFVHVYLFNDGLMITIRNSNSRGIMRYAFESMYELGSLAVVNVRDLGNIKHAFKLLIFPDTRVFQCSSNTSKKEWLDKIDQAKKTKLAAEQQKRESTLSEKLSPSRSTSVDLSINNKPEEVTIIHPEWFLDVADELDVCIAQRHFEDAANYLQKAQNYITKITAQNGELDHVIIDVKKKVEQKQDSLIETLMKELEVNPDKSLQGGLRATRRAVRLLNQLGRSTQSCDLFLKLCSSMLKTQCKRVKREGSTTMYVRHLASVVFTNMCHMSEEFLRAFPDSVDCASAYVVWASGELNLFTTHFIKQVFMPQTSLSTITECVLLVRSQCERLCSYGVDFRYQLDGALRSSFVKALRDTREKLVDSMKLRASEDKWIPMNLVSKASLAKYLQEYSNMGLKLDFYVTGDVWLQLTSCNVAFTKIYLTLVDDCLKLKTTELLHVIEETLYIVFESQMRHNVVSYNNEQQIEQKRFILKNIEFLLVAVLELVQKKFKGETGYESEHLNKLWNEYSGLLKQSSRNTKTKYSSDFL

SEQ ID NO: 10935 - protein, 885 aa, Sitophilus oryzae
MKDVDQLTGKDLNPLSHAPAEREDKDRNPDRPMHSSTSVLRLPVNLDEGEEDSRKRVTRISSPERWEIKQMISSGCIDKSELPDFDDETGLLPKDEEDGEADIEIELVEDEPPFLQGHGRALHDLSPVRIVKNPDGSLAQAAMMQSALAKERREQKMLQREAEVDSQPSGKNKTWIDPLPEEESKDVSARGIGLQSQDLPEWKKHIIGGKKSSFGKKTNLSIIEQRQSLPIYKLKEELRKAVTDNQILIVIGETGSGKTTQITQYLAEEGFTARGKIGCTQPRRVAAMSVAKRVAEEFGCRLGQEVGYTIRFEDCTSPETIIKYMTDGMLLRECLMDLDLKGYSVIMLDEAHERTIHTDVLFGLLKQAVTKRPELKLIVTSATLDAVKFSQYFFEAPIFTIPGRTFPVEVLYTKEPETDYLDASLITVMQIHLREPPGDVLLFLTGQEEIDTACEILYERMKSLGSDVPELIILPVYSALPSEMQTRIFEPAPPGSRKVVIATNIAETSLTIDGIFYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLSKMLIMSVALQCSDEILTIVSMLSVQNVFYRPKDKQALADQKKAKFNQPEGDHLTLLAVYNSWKNNKFSNAWCYENFVQIRTLKRAQDVRKQLLGIMDRHKLDVVSADRNSVRVQKAICSGFFRNAAKKDPQEGYRTLVDSQVVYIHPSSALFNRQPEWVIYHELVCTTKEYMREVTTIDPKWLVEFAPAFFKFSDPTKLSKFKKNQRLEPLYNKYEEPNAWRISRVRRRRN

SEQ ID NO: 10936 - protein, 424 aa, Sitophilus oryzae
MAPYKRNIDDVLARINFPLFTVQMLTNRHVLVGGGGGSAKTGVANGFEIFELSHDGNKFHVEEVTRHETGPNVVMNCAVALKNNHTYLVAGQESHCQLYNVNSELVAQENGDIENLGTDHHTNGKLRHRKSAPTSKNNDINKNLRKRLKFILSPSDSVQTDFNEPEPLCRVVRVHPEGNLMATGGTDGTIQMWRFPSLKPLTKLKGHTKEIDDIDFSLFDNYIITVAKDGQAILWDCVRGKEIKKLTWNQPQGSKYLYKRCRFGIIEGEKKCALYMLSNPTGVAKKQKSFLQQWQPEEETIKRVAIFDESISALAVRDDGRFVAVGTMFSGSVSIHTSFNLQIVLKVPGAHAMFVTGLEFLPVLNQENQTVCSVAEAAVLSISVDNQVCIHTLPYRKTIPLWLAIVILMITLFLTFLFCSYIGL

SEQ ID NO: 10937 - protein, 416 aa, Sitophilus oryzae
MAGAMLFERSQSVRSQHENLMKLKRGDDNEDSDEKSIQNKEQDILNLGEKYKKEGKAKELADLIKQTRPFLSEISKAKAAKLVRSLVDFFLDLEAGIGIEVQLCKECIEWAKEEKRTFLRQSLEARLVALYFDTGMFSEALQLGSTLLKELKKLDDKNLLVEVQLLESKTYHALSNLPKARAALTSARTTANAIYCPPKIQASLDLQSGVLHAADEKDFKTAYSYFYEAFEGFDSVESPKALTALKYMLLSKIMLNTPEDVQQIVSGKLAIKYAGRDIDAMKAVAQASHKRSLADFQQAVKLFKRELEDDVIVRAHLGTLYDNMLEQNLCRIIEPYSRVQVDYIAKTIKLPMPQVEKKLSQMILDAKFHGILDQGEGVLIIFEETPVDKTYEMALETIQSMSKVVDTLYQKAKKLS

SEQ ID NO: 10938 - protein, 590 aa, Sitophilus oryzae
MSSRSKKSATPASQPPPRPSSPLSPTRHSRLQEKADLQNLNDRLACYIDKVRYLESENNRLTREIQTTQETVTREVSNIKSMYDHELSDARKLLDETHREKARLEIDVKRLLDENDELKQELAKKSKDLTLAENSARIYETRCNELQLKYNQANADAKKAIGDLKDLEKERDKLKKLLDEHRKQLEEESLARVEVENANQSLREELSFKDQVYQQQLTETRTRRQIEISEIDGQLAEKYEAKLQQALQDLRDQYESQMASNRSEIELLYENKIKNLQAAANRQSNAASNALDEARQIRSKIDTLTNRVTQLENENSGLVARARDLEKLLENERLRHAEDLAALEGELARLREEMSNQLQEYQDLMDIKVSLDIEIAAYRKLLESEESRLRITPSGGEREVIHSTSTRSSSSRLTPSRLGAKRKRTLMDESHESSFSDYSVTGSSKGDIEILEANPDGKFVKLHNKSNQEITVGGWQIILRAGDNETKYKFIRSAKIEPKGTVTVWSADQNKDHEPPHDLVMKGQRWVTGDNITTTLLNFDGEEVAVSERVKRQLSSSHLRHREMAGGFIGAEDLHHQVGDPQGDEKCRLM

SEQ ID NO: 10939 - protein, 824 aa, Sitophilus oryzae
  misc_feature (277)..(277): Xaa can be any naturally occurring amino acid
MADQQNPEDLATAILRKKDRPNRLIVEEAVNDDNSVVALSQGKMDELQLFRGDTVLLKGKRRKETVCIVLSDDSCSDEKIRMNRNVRNNLRVRLSDVVSVQPCPDVKYGKRIHVLPIDDTVEGLTGNLFEVYLKPYFLEAYRPIHKDDVFIVRGGMRAVEFKVVETDPAPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLXFLINGPEIMSKLAGESESNLRKAFEEADKNSPAIIFIDELDAIAPKREKTHGEVERRIVSQLLTLMDGMKKSSHVIVMAATNRPNSIDAALRRFGRFDREIDIGIPDATGRLEILRIHTKNMKLADDVDLEQIAAETHGHVGADLASLCSEAALQQIREKMDLIDLEDDQIDAEVLNSLAVTMENFRYAMTKSSPSALRETVVEVPNVTWEDIGGLQNVKKELQELVQYPVEHPDKFLKFGMQPSRGVLFYGPPGCGKTLLAKAIANECQANFISVKGPELLTMWFGESEANVRDIFDKARSAAPCVLFFDELDSIAKSRGGNVGDAGGAADRVINQILTEMDGMGAKKNVFIIGATNRPDIIDPAILRPGRLDQLIYIPLPDEKSREAIFKANLRKSPVAKDVDMNYIAKVTHGFSGADLTEICQRACKLAIRQSIEAEIRRERERASNPAAAAAMDLDEDDPVPEITRAHFEEAMRFARRSVSDNDIRKYEMFAQTLQQSRGFGTNFRFPAGGGAPNPGQGGTVPPPVAPGDQANFDDPEDDLYS

SEQ ID NO: 10940 - protein, 274 aa, Sitophilus oryzae
MGDKFDCALDLMRRLPPQQIEKNLSDLIDLVPSLCEDLLSSVDQPLKIAKDNQNGKDYLLCDYNRDGDSYRSPWSNTYYPPLDDGQMPSERLRKLELDANNAFDLYREMYFEGGVSSVYFWDLDHGFAGVILIKKTGDGSKKIKGCWDSLHVVEVQEKSSGRTSHYKMTSTAMLWLQTNKPGSGTMNLGGSLTRQTEQDAAVNENNPHIANIGKMVEDMENKIRNTLNEIYFSKTKDIVNSLRSVQPLTESRQQDALRQDLAAALQRRHNRGDN

SEQ ID NO: 10941 - protein, 893 aa, Sitophilus oryzae
  misc_feature (862)..(862): Xaa can be any naturally occurring amino acid
MQQVEATVQNNTSGKMNEQASSGNGVAAPPASAATMASREVREPPPRNEPVVEPVNGVVQPLVMPPPERPGRITNQLQFLQKTVLKAIWKHQFVWPFQQPVDAKKLNLPDYHKIIKQPMDLGTIKKRLENNYYWSGKECIQDFNTMFTNCYVYNKPGEDVVVMAQTLEKVFLTKVADMPKEEFVVETQAKGAKGKKGRTSTGPTGVTTPGRGRPPATVSSTVSNPVATTTGSMGIPLGTSAPVTVPGSTATTTIAQPNNAQVTPITPTGPSYAAAQAMDTPVSALGVVPPAQPAKSKKGVKRKADTTTPATAYDYLPSGADSNSSSSASKISKRRESGRQIKKPLRNQELDGLGPYGGSAAAGAVPSPAAQAGAHALKNKEKLNDTLKACNEILKELFSKKHCSYAWPFYKPVDAELLGLHDYHDIIKKPMDLGTVKEKMDNREYRSAQEFAQDVRLIFTNCYKYNPSDHDVVAMARKLQDVFEVKIGLVPHESSSSGSSSESSSDTEDSEEERRNKQLKQLEKELTAMQERMRKLVEESTRRKKEKKKQKLKDKPKKMTAAAQAVSAIPNSTGPRGPKPAAAAPSGAAAGPAAKRAKTGRGAGAGTGPGRKKAQAAMPAPAFDSEDEDNAKPMSYDEKRQLSLDINKLPGDKLGRVVHIIQSREPSLRDSNPDEIEIDFETLKPSTLRELENYVASCLRKKPHKKLSGKTKEEQIAEKKKELEDRLLDVNHKIGPSKKAPKKDAKADPTGAGAGRMSSSSSSSDSDSSSSSLSSSSSDSSDSEAGPGATTRQTKKKPGLKKSPNLSVHPSSIASTTLSITTTLQKSSSTTATPTVAPITISATPSVNSAPPAPQQPPPVTXHLGHALSQFRPSRTSTTTTGNVTCQRSGAGC

SEQ ID NO: 10942 - protein, 379 aa, Sitophilus oryzae
MALSTARPLISVYDEKSEEVKGASIALPAVFKAPIRPDVVNFVHQQISMNHRQPYCVSDKAGHQTSAESWGTGRAVARIPRVRGGGTHRSGQGAFGNMCRGGRMFAPTKPWRRWHRRVNINQRRFALAAAIAASGVPALVMSKGHVVDQVPELPLVVSDKVQEFKKTKEAVHFLRRLKAWPDIQKVYKSQRFRAGKGKMRNRRRIQRRGPLVVYHQDQGLRRAFRNIPGIDLISVEKLNLLKLAPGGHVGRFVIWTESAFKKLDKVFENWKAPSTKMSNTDLSRLFKSEEIRAVLRAPQKKIVRRVRRLNPLNNTRALLALNPYAAVLKRQAVLDDKKRSLAREELLAKKRGITLPSSSPVIRSAKLQARRRAAILKAK

SEQ ID NO: 10943 - protein, 1779 aa, Sitophilus oryzae
MADFIESEAEESSEEEELEPHERKKLKKVKAMDDSSEEEDDDDDKLREELHDLIDDNPIEESDGEDSDASGGEKRKKSDDEDLDDRLEDDDYDLLEENLGMKVERRKFKRLRRIQDEESEGEDENDADQEREHIAMDLFSEDDDERRSERSHRPAAEQEQFGEEEEEGEYSDTDDFIVDDDGKPIVRTKKKKIFSDAALQEAQETFGVDFDYDEFSKYDDEYDEEEDDEEDEYEEDEEGERRHRQKKAGKKRPTKKSIFEVYEPSELKRGFFTDLDNEIRNTDIPERMQLRDVPLMAVPDDSTELDEEAEWIYKQAFCKSTISNTDAHLSQEAREKQRKGPQTIGKIRKALDFMRNQQLEVPFIAFYRKEYVQPELNINDLWRVYKYDAKWCQLKTRKENLLALFEKMRSYQIEQLMKNPDAAIPDNVRVMKDSDIERLKNVQTTEELNDVHNHFILYYAQDLAAMHAAWRIKEKERKKQEKREARLKALAEAEDGAEIPDEIPEDEDDDEPEPETIKYANRSGSYALCSKAGLDTLAKKFGLTPQHFAENLRDNYQRHDVDQEPTEPAEVAKEFLSAKFQTVEEVLQATTYMVALQIAREPLVRKCVREAFYERAKLSVAPTRKGQKVIDEAHSCYSMKYLKNKPVRDLTSDQFLKLTLAEEEQLIKIKISDTIEGHTTNSYVDEVKQLYIRDEFSKNVQEWNKLRAECVERALTRCIFPDLQSEIKRILLAEAKEFVLRACCRKLYNWIKIAPYQVEFPEEDEDEWDTAKGIRVMGLAYVPDYSQSAFTCIAAPDGDITDYLRLPHILKRKNSYRQEEKLMKEADLTALRNFIYTKKPHVIAIGGESREALMIADDLRGIINDLVEAEQFPTLKVEIVDNELAKVYANSNKGTADFRDYPELLRQAISIARKMQDPLIEYSQLCNGDEEILSLRFHPLQEQIGKEELLEALCLEFVNRTNEVGVDVNLAVQQAHKSHLIQFLCGLGPRKGQALLKVLKQTNQRLENRTQLVTACHMGPKVFINCSGFIKIDTNSLGDSTEAYVEILDGSRVHPETYEWARKMAVDALEYDDDEGANPAGALEEILETPERLKDLDLDAFAEELERQGFGNKSITLYDIRAELNSRYKDLRTPYRSANPEELFDMLTKETPETFYIGKLVQASVIGIARRKPQGEQLDSANPVRNDETGLWQCPFCLKNDFPELSDVWNHFDAGSCPGQATGVKLRLDNGISGYIYIKNLSDKTVSNPEERVGIGQLIHCRIMKIDVERFSVDCTSKSSDLLDKNHEWRPPRDPYYDQEQEDKDNRTEAEKKKDKQKQTYIKRVIVHPAFHNISYAEAEKCMVNMDQGEVIVRPSSKGVDHLTITWKVADNIYQHIDVKEEGKANAFSLGKSLWIANEEFEDLDEIIARYVNPMASYARDLLYFRYYKDTEGGLKDKAEEFLKEEKKKNPAKIHYVISAAKSFPGKFMLSYLPRNKVRHEYVSVTPEGFRFRQQMFDSVTSLFKWFKEHFRDPIPGGTPSTPRLGSGRTPYQGTATTPFNGMNPEAIQRVAQNLPTHMLQSLSAVANQTPHYPHTPGGAYGANYINTPYTPSGQTPFMTPYTQQTPRYGQATPSPVPAGMASGPFLHPGAVTPSHRTPNSYRNLPSQSPMITASPVPSPASQSSYSSQSRRSAPRSGPIPGYGTGAYANSEQMDWQKAAEAWAARSRTTPRSDSGRITPRGSTGLRTPKFDDIRADLERTKMKNVGKSPKSLRSTPRTNMSPHSMSLGDATPLYDENI

SEQ ID NO: 10944 - protein, 828 aa, Sitophilus oryzae
  misc_feature (733)..(733): Xaa can be any naturally occurring amino acid
VTKERSKKRENRSEKGKKRSSRSRSSSRERRRKDRKRRKADNSDEAVILPRYYGDDRRKENNDRYWTKYPKKDENVVGKRYYDTKSIDEDKVKEKEPQKDASEDKSIIKPREKKTVDLLTSKTGGAYIPPAKLRMMQAEITDKSSAAFQRIAWEALKKSIHGYINKVNTSNIGIIARELLHENIIRGRGLLCKSIIQAQAASPTFTNVYAALVAVINSKFPNIGELLLKRLVLQFKRGFKQNNKTICISAATFVAHLVNQSVAHEILALEILTLLIETPTDDSVEVAIAFLKECGQKLTEVSSRGINAIFEMLRNILHEGQLEKRIQYMIEVMFQIRKDGFKDHAAVIEELDVVEEDDQFTHLIKLDDVKQADSDEILNVFKFDDDYQLNEGKYKILSKEILQTDSESGSGSEEGGSDDEEDDSDDEEEEGEEAKVKDTIIDNTETNLIVLRRTIYLTIQSSLDFEECAHKLLKMELKPGQEIELCHMFLDCCAEQRTYEKFYGLLAQRFCQINKTYVEPFQQIFKDTYATTHRLDANRLRNVSKFFAHLLFTDAIGWEVLEIMKMNEEDTNSSSRIFIKILFQELAEYMGLGKLNARLKDPTLQGHFAGLFPRDNPKNTRFSINFFTSIGLGGLTDELREHLKNIPKNLPVVTKEESEESSSSSSSSSESSDQDSSSESSSDSEEDRRRRKKKDKKQSNKKESKKSTKNDSKSKDEKRKDNKNRKERNKEEXNKNRKERNKEESEDSDSNKKHERNARKKDYQWMKSRYEDNISQLKNKRRDFERPRSRDRNRVKVEKERRSRSRERYHRADNNDHRERTKRDRRRS

SEQ ID NO: 10945 - protein, 596 aa, Sitophilus oryzae
MALKNQVGQKIMNEVIKYRPPKKNGPGAKMEWRVLVVDKLAMRMISACCKMHDISAEGITLVEDIFKTREPLSSMEAVYLITPSKESVEALMRDFDGIKHIMYKGAHVFFTEACPPPLFDDLCQHKVAKYIKTLKEIDMAFIPNEAQVFSLDCTETFQCYYNPAYSQKYTANLERMAEQIATLCATLGEYPSVRYRSDWDKNVELAQLIQQKLDAYKADEPTMGEGPEKARSQLLILDRGFDCVSPLLHELTFQAMAYDLLNIQNDVYEYEASAGVKKEVLLDENDDMWVELRHQHIAVVSQSVTKNLKKFTDSKRMTASDKQSMKDLSTMIKKMPQYQKELSKYATHLQLAEDCMKQYQGYVDKLCKVEQDLAMGTDAEGEKIKDHMRNIVPILLDPKITDQYDKMRIIALYAMTKNGITEENLQKLATHAQISQKQTIANLQYLGVNVINEGGIRKKPYTVPRKERITEQTYQMSRWTPVVKDIMEDCIEDKLDQKHFPFLAGRAQSTGYHPPSSARYGHWHKDRSQQTVKNVPRLIVFVVGGICFSEVRCAYEVTNALKNWEVIIGSSHILTPKTFLEQLTELTPNFLFHPNF

SEQ ID NO: 10946 - protein, 634 aa, Sitophilus oryzae
MFFQEIYNLLEQNKQSMDNFQELDSKINIVATKVLHLGDQLDSVNGPRARVVDAQKLLSHLSEFLSNGPLTSSIFNDPYRIDEAADVIQKLFLISQDLPSPKFESVKRKIERTYSDIEKALIEEFVRAMTKEDLTRMRTIANVLSQFKGYSQCVDAYIDQSQTGCLLGKDVFANLVLLCKHNYDIIREVFNNSEQVMAKFVLNLYQLKLSDYIDSKLSAKMGSHGYLQMLYELYSKTNQFSNELSVYNLGNDKNYLTKLTSNIFTKHISEYIQIELKSLKDRCATNLQRYYDTKNHQKKQIQSGGFQDLRRDLQAVIGTRANINIAQIENYGGETFLSEELAIMILQDTKNAFSRCQLLSKPEERAGNASKILNTLVNSLLIEHVDYAVELGLHAIPVVEGAKNSPVLYFFTVVHQSNNITHLAERQFMDLVVPLVHNTPYHNDCIQKKKFVLEDIERKINLGLDRCLNAVTTWVKLYLQSEQKKSDFKPETDDFDTVASPACKHVSQYITSIKKEIQTSLDGNNVTAVLEEFGIRLHRTIYDHMLQFQYNTAGAMIAICDLNEYRSCTKSLGPLVTELFETLHALCNLLLVKTENLNQVCSEDSLVNLDKSILHNFIQLRSDYKAQKPPFFKV

SEQ ID NO: 10947 - protein, 290 aa, Sitophilus oryzae
MDFQNRPGGKTGGGGVASWSESNRDRRERLRQLALETIDLQKDPYFMKNHLGSYECKLCLTLHNNEGSYLAHTQGKKHQANLARRAAKEAKDAPSLLQPEKPRVEPKKFVKIGRPGYRVTKQRDPETGQQSLLFQIDYPEISDHVLPRHRFMSAYEQKIEPPDRKWQYLLFAAEPYETIAFKVPSREVEKTDNKFWTHWNRDTKQFFLQFAFKTENKKQPTIINRQTMITGVPPPPMLPVPPPPRPPMFNPMPPATSTTTTKTSYVQSHATTTSYDESSDACSSTALNFK

SEQ ID NO: 10948 - protein, 135 aa, Sitophilus oryzae
MSIGVPIKVLHEAEGHIVTCETITGEVYRGKLIEAEDNMNCQMTQITVTYRDGRVAQLENVYIRGSKIRFMILPDMLKNAPMFKKQTKSGTAGRGKSGILRAQARGRGRGGPPTRGGRGGAPWPNQQVGPGGRGR

SEQ ID NO: 10949 - protein, 439 aa, Sitophilus oryzae
MASSITKGPLLRIVTARGYSQVAPVNGIANYDLKTTTLTNKLVVVAAENESALTRISVTFRAGSRYETSDNLGAVHVIRTAAGLSTKNASQFAIIRNIQQVGASLTATADRETISYTLEGTRKAVEQVLPFLKEVATEQVFKPWELSELGDRLKIDLAVRPLQLRALDLLHKAAYRTGLGNSQFVPKFQIGKLSCETLQHYVANTFTSSRAAVVGFGIDNSSLTQFAQSLNLEPNEGVSNPSPYKGGEIRSDKGGDFAFVAIAGEGAAVNNPKEALAAAVLQNVLSAGPQLKWSTNDNGVIPRALGGTDGYSVRGINASYKDTGLVGILLAVPAKSAKKIVPGAVNAFKSASVTDADVNRGKNLLKTSLLSELESGSTAAQVYGAQAALTGTALSAEEVASVVDSVSASDVNSVLQKARKNISIASVGNLADVPYADDL

SEQ ID NO: 10950 - protein, 110 aa, Sitophilus oryzae
MRRAHTGNYYEPLPQENNEMEQENERMAQDLSDKIGVLKSLSIDIGNEVKYQDRLLRDVDDDMERTGGFLGRTMQRVVKLSRGSQNYIVLYLFLFSIAVFFILYLVLKFR

SEQ ID NO: 10951 - protein, 496 aa, Sitophilus oryzae
MSYPSSLSAKQATREHVLAVSRDFVSQPRLTYKTVSGVNGPLVILEDVKFPKFNEIVELKLADGSLRSGQVLEVSGSKAVVQVFEGTSGIDAKNTLCEFTGDILRTPVSEDMLGRVFNGSGKPIDKGPPILAEDFLDIQGQPINPWSRIYPEEMIQTGISAIDVMNSIARGQKIPIFSAAGLPHNEIAAQICRQAGLVKVPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPVNVLPSLSRLMKSAIGEGMTRKDHSDVSNQLYACYAIGKDVQAMKAVVGEEALTPDDLLYLEFLTKFEKNFISQGNYENRTVFESLDIGWQLLRIFPKEMLKRIPAATLAEFYPRDSRH

SEQ ID NO: 10952 - protein, 108 aa, Sitophilus oryzae
MEYDKEEPDDTEETEAKSIPAIFKDQVLEFIMNILLDHPEDIMEYGQSYFKKVEENRRTTIVYDLVKVSNENLTGGGQRDTDNVDNTTRNAENDSEKIVRSISANFSF

SEQ ID NO: 10953 - protein, 773 aa, Sitophilus oryzae
MSYQSRSMSYQNASDMPKSNSKDPAVMSWQQNNYMGDSGIHSGAQTQVPSLSGKEDLSEDLFDLDQGGYPGFTQDQVDEMNNQLTQTRSHRVRAAMFPETLEEGIEIPSTQFDPQTQTAVQRLAEPSQMLRHAVVNLINYQDDAELATRAIPELIKLLNDEDQVVVSQAAMMVHQLSKKEASRHAIMNSPQMVAALVRAISNSNDLETTKGAVGTLHKLSHHRQGLLAIFKSGGIPALVKLLSSPVESVLFYAITTLHNLLLHQEGSKMAVRLAGGLQKMVALLQRNNTKFLAIVTDCLQILAFGNQESKLIILASQGPIELVRIMRSYNYEKLLWTTSRVLKVLSVCSSNKPAIVEAGGMQALAMHLGSGSQRLVQNCLWTLRNLSDAATKVNGLDTLLSSLVQVLSSPDGNVVTCAAGILSNLTCNNQFNKETVCQYDGISALVRTIVNAGDHEEITEPAICALRHLTSRHDKSELAQNQVRVVGGIPVIVRLLNPPSRWPLVKAVIGLIRNLALCPDNFLPLRESCAINYLVQLLMRAYQDTQRRASLASGGSQPPGTYADGVRMEEIIEGTVGALHILAREWNNREQIRQQRVIPIFVQLLFNDIENIQRVAAGVLCELAADKEGADMIEQEGATAPLTELLHSRNEGVATYAAAVLFRMSEDKPQEYKKRLSMELSSSLFREENLWNPDLGMGTDFQDMLSPEQAYDNMYAQDPPSVHSSHGGRPYQQQQALFSELQINMDMDMDTMEALPAPPESNDQVAAWYDTDL

SEQ ID NO: 10954 - protein, 268 aa, Sitophilus oryzae
MARNAEKAMTTLARWRAAQLGENEKVKKRRPYLASECKSLYACEKWRLQIIREIAKKVAQIQNAGLGEFRIRDLNDEINKLLREKRHWEDQIKELGGPDYQKVGPRMLDHEGKEVPGNRGYKYFGAAKELPGVRELFEQEPPPPPRKTRAELMKDIDADYYGYMDDDDGILIPLEIKAEKIALQKVDAEWKSKKEQAMETDTPEEEYEEENIYKVHDSDEEQEKEIVDGSQQRFVAHVPVPSQQDIEQALLRRRKQELMEKYGIPSEQ

SEQ ID NO: 10955 - protein, 215 aa, Sitophilus oryzae
MAAEQEMPTFKCVLVGDGGTGKTTFVKRHLTGEFEKKYVATLGVEVHPLVFHTNRGPIRFNVWDTAGQEKFGGLRDGYYIQGQCAIVMFDVTSRVTYKNVPNWHRDLVRVCENIPIVLCGNKVDIKDRKVKAKSIVFHRKKNLQYYDISAKSNYNFEKPFLWLARKLIGDPNLEFVAMPALVPPEIQMDPHWQQQIEKDLKDAQDTALPEDDEDL

SEQ ID NO: 10956 - protein, 129 aa, Sitophilus oryzae
MVLTTIASIIVKIVKLVLNLIIIIIYRVGFQGDFLGVGGTWNLYEDKNSDVEIIASGVFVGYMVYNIVSLISMCFADSENKSTFTDILMNIVGIFLWVAVGATALHYWHGYLAEHKYTYVNSERQVGLA

SEQ ID NO: 10957 - protein, 847 aa, Sitophilus oryzae
MPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEDGEDTADDPRKLKPGEIDPNPETKPARPDPKDMDEDELEMLSEARARLANTQGKKAKRKAREKQLEEARRLAALQKRRELRAAGIEVNPRRRKKRGVDYNAEIPFEKRPAIGFYDTSNEALDPMAPDFSKMTQQALDGEIRSEQEEKERKKDKQKLKQRKENDIPQAMLQNQEPAKKRSKLVLPEPQISDQELHQVVKLGKASEVAREVASESGIDSTDTLLNDYTLTPQAAATPRTPAPVTDRILQEAQNVMALTHVDTPLKGGLNTPLHNSDFSGVAPQAQTIATPNTVIATPFRSARSDGGITPASSGFATPRSGALVPVGQGSSFTPSVRDKLNINAEESLEAAETPVQQRIYQTSLKEQLKMGLSSLPQPKNDYEIVVPEQVDQEMPEQAQEHMIEDQADIDKRYQEDLKAKAAKELAMRSQVIQRDFPRPLDVNLSVLRPPNENYSLTELQKAEELIKCEMATMLHFDNLKNPIPNQSKQSTKSQAQQLAFLEEHPYQNFRPDELELSKKMLKKEMEIVKMGMNHGELPIEAYTQVWEECLGQVLFLPNQNRYTRANLANKKDRLESAEKRLEQNRSHMAKEAKRAAKMEKKLKILTGGYQSKAQVLIKQLQDAYENIDQANLELNTFKFLQEQEKNALPRRVESLTEDVDRQMEREKGLQKRYNDLQNEIRELQEQYKYVQQEVYEEQSQQNVVTDETVENHISDDQNVVSSSTVNGIDESPEDESNMN

SEQ ID NO: 10958 - protein, 164 aa, Sitophilus oryzae
  misc_feature (152)..(152): Xaa can be any naturally occurring amino acid
MMQFMLLFSRQGKLRLQKWYVAHPDKLKKKITRELITTILARKPKMCSFLEWRDLKIVYKRYASLYFCCAIEQDDNELLTLEVIHRYVELLDKYFGSVCELDIIFNFEKAYFILDELMLGGEIQETSKKNVLKAIAAQDLLQEEETPQGFFXRRHHKDSLMTMD

SEQ ID NO: 10959 - protein, 419 aa, Sitophilus oryzae
MHQFSKFMFTQVTRSTRDAIRHYSREPQRRPSFLSRLYDNFREELAKNKEMKESLKKFKEEAERLEQSDALKAARQKFETVEKEATKSSDILKEKLTTIKDKVQGVLDETGKTEIAKKAGKLSEGISKTAHTIGEKAQEIGKTGAFQSISKATEAVKSEIDTTSMQGRVYVSPTKLRKRKETTAVQHQKYYEPNTEASGVELHKDSKFYQSWQDFKDNNPYVHKVMDWKLKYDESENPLIRASRALTEKVSDVMGGLFQKTELSETLTEICKIDNTFDTKRFLKQCETDIIPNVLEAMTRGDLEILKDWCHEGPYNVFAIPIKEAYKKGYKIESKILDIDNVDLVMGKVMDQGPVLIISFTSQQVMVVKDLEGNVVEGDADKIMRVNYVWVLCRDVTETDPRSAWRLLDLSASSNEQLV

SEQ ID NO: 10960 - protein, 306 aa, Sitophilus oryzae
MEYSSDSELSDSDKELQEAFAEGKLKPGLNTVHEAPKSFINNVQGLKHKLDEIKLNLTWLERLDSVNDQAPLAPELAAQMLAHEHKRENQLKNNKKLPQFSPTEDPVLNDFKREMCFHRQAQATILEAIPKLTKLGLPTRRPEDYFAEMAKTDEHMQKIREHLMQKQQQQQRSERVKQLRQQRKEGKMLQIQTKLQRMQEKKEMLDQVKKYKKGVSKDLDFLDSKKNTSSKAISRKSLEKRRQKNKKFGFGGKKKGMKLNTKDSAADISEYRKPSKGPSKGKKGKGQMKNSRPGKNRRIKNKTKRK

SEQ ID NO: 10961 - protein, 205 aa, Sitophilus oryzae
MDEVKKLEYLSLVSKICTELENHLGMNDKDLAEFIIFLSEKNNTVDTFKKALTENGAEFSDSFVSNLLRIIQHMRPKTKDASSEINDEDKIEKSFLAQKFPGLALPNEPQKPLSDDEVEKDEETNNEEGDIVADLMAQFEADAPSAVKKTKSKETERDRHRSRSRHRDKSRSRSRDRRRDRSRENRRNRIRDRSRDRDRDRDHYK

SEQ ID NO: 10962 - protein, 625 aa, Sitophilus oryzae
MNQGAPNYPMASLYVGDLHSDITEALLFEKFSTAGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDENGASKGYGFVHFETEEAAKKSIEKVNGMLLNGKKVYVGRFIPRKEREKELGEKAKLFTNVYVKNFGEDLSEEQLRNMFEKFGKITSYKIMSKDDGKSKGFGFVAFESPEAAEAAVENLNGKEMVEGKSLYVGRAQKKAERQQELKRRFEALKIERLNRYQGVNLYVKNLDDTIDDERLRKEFSPFGTITSAKVMMEEGRSKGFGFVCFSSPEEATKAVTEMNGRIVGSKPLYVALAQRKEDRKAHLTSQYMQRMANMRMHQMGPFIQPGGSSYFVPTLPAQRFYGAAQIPQMRTSPRWPAQNPVRPGGQAGPTAYANMPTTYRATARPPNQTAAMRSNINVPRPITGQQPPNIQGRPLAGQSVVAAGGSRTPNFKYTSNMRNPPPSMGTMPAAPVQQAVHIQGQEPLTATMLAAAPPPDQKQMLGERLFPLIQRMYPDLAGKITGMLLEIDNTELLHMLEHNESLKNKVEEAVAVLQAHQAKQAATQIKKD

SEQ ID NO: 10963 - protein, 924 aa, Sitophilus oryzae
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSAQNTNLGLVEDQGFLEQLKELLSDSNPMVVANAVAALSEINESSPTGQPLVELSTSTINKLLTALNECTEWGQVFILDSLSNYTPRDEREAQSICERITPRLAHANAAVVLSAVKVLIKMMEILQGDVEFCNTLSKKLAPPLVTLLSSEPEVQYVALRNINLIVQKKPDILKHEMKVFFVKYNDPIYVKLEKLDIMIRLASQSNISQVLSELKEYATEVDVDFVRKAVRAIGRCAIKVEPSAEKCVSTLLDLIQTKVNYVVQEAIVVIKDIFRKYPNKYESIISTLCENLDTLDEPEARASMVWIIGEYAERIDNADELLDSFLEGFADENAQVQLQLLTAVVKLFLKRPQHTQGLVQHVLSLATQDSDNPDLRDRGFIYWRLLSTDPAAAKEVVLADKPLISEETDLLEPTLLDELICHISSLASVYHKPPTAFVEGRSAGIRKTLPVRQGSDEAPAQEATVIPNQESLIGDLLSMDLGAPTIPSGPAPTTAPISNVDLLGGGLDVLYGGTELSGAPTAAAPSTTGLLGDIFGITTTPTMYTPPKTLWLPADKGKGLEIRGTFSRKSGQVHMEMTLTNKAMQVMSGFAIQFNKNSFGLAPLVPMNVTGLQPGQSLEYSLALSTTGPVQRMEPLTTLQVAIKNNVDVFYYACQIPIQILFLEDGTLDKRVFLTTWRDIPSANEVQYTLNDIKGSADAISSKMTMSNIFTIAKRNVEGQDMLYQSLKLTNNIWVLLELKLTPGSTTATLSLKSRSVEVAPYVFQAYEMICKN

SEQ ID NO: 10964 - protein, 165 aa, Sitophilus oryzae
MPPKFDPNEVKYVYLRCVGGEVGATSSLAPKIGPLGLSPKKVGDDIAKGTADWKGLKITVQLKIQNRQASISVVPSAASLIIKALKEPPRDRKKQKNIKHSGNISFDDVLAIARQMRPRSMAKALSGTVKEVLGSAQSVGCTIDGKAPHDVIDEVNDGSIEVPDE

SEQ ID NO: 10965 - protein, 384 aa, Sitophilus oryzae
  misc_feature (262)..(262): Xaa can be any naturally occurring amino acid
MGESGMRALILVGGYGTRLRPLTLSRPKPLVEFANKPILLHQVEALVKVGVSEVILAVSYRAEQMEKELVLEAKKLGVKMVFSHETQPLGTAGPIALAAEHLTKDNKPFFVLNSDIICDFPFKKLMDFHKAHGKEGTIVVTKVEEPSKYGVVVYDETKCIESFVEKPQEFISNKINAGLYILNPSVINRIELKPTSIEKEVFPNMAAEKELYAFELQGFWMDVGQPKDFLIGMCLYLKHLRTTDPERLYSGPGVVGNVLVHXTDPERLYSGPGVVGNVLVHSTAKIGKSCQIGPNVVIGPGVVIEDGVCIKRSTILEDATIRSNSWLESCIIGWRCIVGQWVRMEGITVLGEDVIVKDETYINGGQVLPHKNIGDSVRTPQIIM

SEQ ID NO: 10966 - protein, 285 aa, Sitophilus oryzae
TDGEEIPDQEKVRIVSDFILRSPPGEFNEVFNDVRKLLDDDDLLKEGASGAFAQYNKDQLTPVRIDNADHLVLITEYNDLGNNRFFDSRSKQSFRYDHLRKEASDYQPFTPDATAEPWRSALDAEFIQYTRNHYKDGVSLVVGRSEGNTITLAACIEDHQFQPKNFWNGRWRSQWYISLNGTSTAELRGVLKVQVHYYEEGNVQLVSTKEIKETITVSSETQTAKEIVWAIENAEDSYQTAISVNYQNMSDTTFKALRRLLPVTRTKIDWSKIVSYSIGKELKTQ

SEQ ID NO: 10967 - protein, 1385 aa, Sitophilus oryzae
MKPKWVLVALVLCLCTISFGQDVNPDAEAVPGVESDGNTDQDGQPVPAEEQPEEGANGDVPSTAYEEPSVDNSPPNPEDSNAPSSDVESMDGSDTTGLKTGQKIFKSGKYITYYGADYDPMNSRIAPPDTDQRGGAGTPYTLTDQRLSTIRQIFMYPFYDQGGNADNEGDYQKEIQSSSPQVHKNLNFQLPFFGFRFNYTRVSLNGYLEFSDPPPNYDYPLVFPTRDWPKKNDPSFIGVFFSKCRIGDLRDGDIDPRKPGVYFRMERDLRQRNDQMGVEIRERLKWDIREGVIGSETFDPKHAIIITWKNVSFNGGFANAKYRTNTFQAVLATDEVYTYAMFNYLNLAWTSHTEAGGDTITGEGGVPAYIGFNAGNGTRNWEYSPYSQASVLRDLTATGFANGFPGRHLFRIDENILVGTCNKDIDGANLPLMFAPESGNMLGGTVVNITGPCFNPSDQVLCKFDVADVVYGVVVSRNRAICIQPPLMVEGYVRLEIAIGPGTYKWKGRYYVENPASAAQKIYFKDMKVHDKSPAEIKITWEKYNLTTNDNANIRISLWGYRETTIRPAFLYITDIASNVQNTGEYTIVPSQYRNRENTFLTDIKFGFIQINLTDTIPVQSDYNSAAQSVEINPVVWSRPIPLGWYFGWQWERLYGTNWPEYLCNDWLRTDRYLKNFAHELPQCPCTLEQALADKGKYMPDWDCDKDSNPTCYYNNQAVHCVKTGSPTLEGSEQQCCYDKNHYLMLSYDQQWGSSPRRCHNLGLMPYQEATKVPTLSQWFNDVVPKYLCCLWQDEQAVGCETLRFERRPTQDCVAYQAPGVAGVYGDPHIVTFDDLEYTFNGKGEFVLIKSNARLDNIEVQGRFEQMDPNLYGEVRATQLTSVVARGNSSTVVEVRRRPEYARWRYRLDVITDGKRVYFDRPSLKFQHFPGVTVYTPTYILNQSEVIMMFDNGVGVEVLDNQGYMTARVYLPWSFINKTAGLLGNWSFNKEDDFTLPDGSRVSVVSNINDMQRVYTDFGSKWMIDDVLDSQKGRALFLRENGLTSSNYNNRSFVPVFVMTPEEIIPANRSEQITRTYDVCSTKMYECYYDYAMTLNRDLAHYTQNYKATIYQLKEVSRTKVVSCGILETPRFGRKSTFLFVPGTKVTYECNQDFVLVGDPRRTCLATGQWDTPEYGYTYCLRQQEYSQRNAAITSGIIFAVLIPLVLVIVFIAFKVYQKYMNSDDSSWQYAQKPALAARSFSPTESNKSPLSDTSTSSVFKPRIMYDKSYRTHEPLVGLPETEFESKQVDPNDVGYEIDRKSLSSPNIPVSPTPSSVSYTMPYQQKPDIVNYGSKPKLDYGSDDYAQPYKPTSSSSDPASPTTGKLSPITYRDRVASRSSVITDV

SEQ ID NO: 10968 - protein, 124 aa, Sitophilus oryzae
PAGGGGAAPAAAARSAERRVGTECGSRGSPDHCDIEKILGSVGIEADGEKLKRVISELNGKSIDELIAQGREKLSSIPAGGGGAAPAAAAGGAAPAAEEKKDAKKEEAKEESESDEDMGFTLFD

SEQ ID NO: 10969 - protein, 910 aa, Sitophilus oryzae
MTTTDHFGLKWDPKNLEIRTMSVEKTLEPLVLQVTTLVNTNGPSKKKKGKSKRANALVSTVEKATENFIEKGEQIAYENPDITEEMLAAVDEVRKTGTQMSRDAREFSEDPCSSLKRSNMVRAARNLLSAVTRLLILADMVDVHLLLKSLHIVENDLEKLKNASSNGELLDNIETFRQNANELMNQAAKRQQELKDPQLRDDLAAARAVLKKHSTMLLTASKVYVRHPELAAAKANRDYVLKQVCEAVNTISDVAQGRTPPVAGPYDGPGELAAALDDFDENIVIEPLAYNEVHTRPSLEERLESIISGAALMADSSCTRDDRRERIVAECNAVRQALQDLLSEYMSNMGNKDKSESLANAINNMKGKTKDLRRQLRKAVVDHISDSFMETSIPLLILIKAAENGDEKQVEENAYVFTEHSNKLVEVANLVCSMSSLEDGVKMVRYAAAQIDSLCPEVINAARILAARSRSKVAQENMDAFKYNWENQVRILTEAIDDITTVDDFLAVSENHILEDVNKCVLALQENEADTLERTAAAIRGRTGRIAVVVAAEMDNYEPCIYTKRVLEAVKVLNDQVMPKFTQRVQVAVQTILSGQQGQPAKELDENEFIDASRLVYDGVREIRRAVLMNRADEDLDPEDVELDENYTLETKSKSSAHTGEHNVDEYPEISGITTAREAMGKMPEEDKQKILQQVEYFRSEKLKFDREVAKWDDTGNDIIVLAKHMCVIMMEMTDFTRGRGPLKTTMDVINAAKKISEAGTKLDKLTRQIADQCPESSTKKDLLAYLQRIALYCHQMNITSKVKADVQNISGELIVSGLDSATSLIQAAKNLMNAVVLTVKASYVASTKYPRQQGTVASPIVVWKMKAPEKKPLVRPEKPEEVRAKVRKGSQKKVQNPIHALSEFQTESV

SEQ ID NO: 10970 - protein, 406 aa, Sitophilus oryzae
MYSVYCFKEIPNNYCYKTMSFSFGAPPKTTTAFALPTSTTVTKAATTSAPTLQFSFGGATPSPITSTGPSTGLQFNFGGASTTPANANTSLTTSFTPILAPASAATNTGITFGTPAATVGASTATFGAPTTTFGAPTTTFGAPTTTFGAPTTTFGAPTTTFGVPTTTTTAVVLGQTTSVAPVTTSAPSFPSRSIAASNVAPTVTTTTTTSIPATGSLTFVQLEDLINKWTIDLEEQGKYFVNQAKQLNAWDTLLISNGEKILNLNSSIERVKQQQSQLDQELDFILAQQKELEELIVPLEKELVDVPVTDIDRNQMYQFAEIIDSQLKQISDDLKEIIENINETNKDEEVSNPITQISKILNAHMNSLQWIDRNTAEISRNLEEISKIEDANRRNLSLNSSLNLFQ

SEQ ID NO: 10971 - protein, 211 aa, Sitophilus oryzae
  misc_feature (189)..(189): Xaa can be any naturally occurring amino acid
MFIWDWFTGVLGYLGLWKKSGKLLFLGLDNAGKTTLLHMLKDDRLAVHLPTLHPTSEELSIGNMRFTTFDLGGHVQARRVWKDYFPAVDAIVFLVDASDRMRFDESRQELISLLTDESLANCPVLILGNKIDLPVAASEDELRNVFALFGQTTGKGKVPRSDLPGRPLELFMCSILQRQGYGEGFRWLXVHVLHPPETGIRRRFSLVGAVH

SEQ ID NO: 10972 - protein, 207 aa, Sitophilus oryzae
SFGTANQFFIFFFLKLSTKNSDMDAVDLLEKRIEALELQILPKDKSVLSNKSQTIADLLTETQTMISSALSCRESVTSLLQHMHTINEYLDPSSGEYDLEADIKKQYLLQIYPELKARVELIKTFNNLIQFTNSESLQKVTELSGKLQTLAGSNVEIYEECKEVNENVLKALQEYNNISNTIKVLFTQMDKDISQFEYTQNIKISTE

SEQ ID NO: 10973 - protein, 581 aa, Sitophilus oryzae
MSNSDVYNDLTLYITPEKFYIEPKTSDELLVIDRGSEAVTVHRNTGQIPAANSNKDFCGLLGSINLLAGRYLIIATQRDLIGYIGGHPIWKLVKTELIPYCRSMLHLTNEKLADNNTYVNMVENVLATPSFYFSYSYDITHSIQRLHDLTPDFWQQSMLQRADNRFVWNRYLLEQFKETNAKRFSLPLLHGFVSINQCVINGRNFTWAIISRRSIYRAGTRWFRRGIDKDGNVANFVETEQIVESSEGDRASFVQIRGSIPLFWYQKPDLRYKPSITLDLGVDVQDQQAACLRHLETTAGIYGRQVMIDLVDQVGSEGRLEKAFKDTISYLSHPSVRYEPFDFHAECRKMKWHRLSILTDRVALDQDDMSYFLILSDGTFSSLQEGVFRTNCIDCLDRTNVVQSMLAHRNLEIVLRKFTILSYDQKLEDYRTFESLFKNVWADHADLISIQYSGTGALKTDFTRTGKRTKSGMIQDGINSLIRYYKNNFNDGSRQDSIDLFLGNGKVVSPLAPPPGWRYITFPSVLLVATAMFVASVIFPAEYSSECLLYLMFWGGMMASTTYYIFQYGVEFVDRPKLTPT

SEQ ID NO: 10974 - protein, 464 aa, Sitophilus oryzae
MPPTIQNGSNPVEKRPERPTKPVEKRSDLICKVKYCNTLPDIPFDLKFISYPFESSRFIQYNPTSLERNYRYEVLTEHDLGVSIDLINKDIYAVDHGATLDPADEKLLEEDILTPQDSKRSRHHAKSVSWLRRTEYISTEQTRFQPQTMDKVEAKVGFSIKKSFNSETLYMDRDSQIEAIEKTFSDTKVPIEKHYSKPNVTPVEVLPLYPDFNLWKYPCAQVIFDSDPAPVGKQVPAQIEEMSQAMIRGVMDESGEQFVAYFLPTEETLTKRREDFANNVTYRDDEEYEYKMAREYNWNVKSKASKGYEENYFFVVRQDGIYYNELETRVRLSKRRQKVGQGPSNTRLVVKHRPMNEMEFKMKRYREKQLEPPGEDDEEMELEEQQDEQEQQQGDDSHAESDQEQEETKDSGNESNEEQNDKENGVRESRASSRSSRKSKSASRSRSRSASGSRSHSKSKSRSR

SEQ ID NO: 10975 - protein, 389 aa, Sitophilus oryzae
MPIENLEDQGLEKNPDLELAHFKFLLTLPEYRNDKTVHAKITEAIKKDDMAPWYELICQEIGWKLDEKLLKTIKAKNDEQVKKLNEAIEDAEKNLGEMEVREAYLRKAEYYSRIGDKENALSTFRQTYDKTVSLGHRLDIIFHLIRIGLFFMDHDVITRNIDKAKTLIEEGGDWDRRNRLKVYQGAYCMAVRDFKTASNLFLDTVSTFTSYELMDYKAFVRYTVYTSIISLPRNQLRDKVVKGSEILEVLHSEPFVKDYLFSLYNCQYAEFFGNLAKVEEVLRKDYFLNPHYRYYVREMKILAYTQLLESYRSLTLQYMAEAFGVSTEFIDDELSTFIATGRLHCKIDRVGGIVETNRPDLKNAQFNSVVKQGDLLLQRVQKLSRVINI

SEQ ID NO: 10976 - protein, 303 aa, Sitophilus oryzae
DDDNTEDLKDVLALSGDLLDPDLVNSIINEEDDDLTKNTELETLGDEGELSQTLGSTESSKDAKDELSDILGPHFSLESIQNINSKDVEDIFKGVLTDESQESQLSQETNIFPPIQSSTQAMFAGSMSQPSPVSIPQMPQITSGAVRPTALPGVQHASFPPSPYHSEYSNSPQFSPAFSEPPSPWVSMSEGVEIDSTSVGVASTYNQRSSEKMKADEALGSGATISAVLYANMNHPEWKTEYPAWSDRYKQLIKKWRTLSQEQKAPYLQQARDNRSQLRMKKQQQSQTAKDSSASSPVPGPKP

SEQ ID NO: 10977 - protein, 147 aa, Sitophilus oryzae
KGPCWLDVRNPELNNNPLSWCKFEVNCVVKNIVKVDEQLERPPLVVSALNFRHYRNPRTHQNEILMISCITQTKYSVDKQQPKPPFNEHFCVFTSPAKQPLPMNIYECLKTYKGTKVQKMDSEKALLNYFVTQFLKIDPDMIVGFDM

SEQ ID NO: 10978 - protein, 479 aa, Sitophilus oryzae
  misc_feature (50)..(50): Xaa can be any naturally occurring amino acid
MAVAAAAKIAEVRETTRVERIGAHSHIRGLGLDDSLEARHVSQGMVGQVXSLEARHVSQGMVGQVSARRAVGIVLQMVRDGRIAGRAVLLAGQPGTGKTAIATALAAALGYDTPFTSMAGSEIYSLEMSKTEALTQAIRKSIGVRIKEESEIIEGEVVEVQIERPATGVGTKVGKLILKTTDMETVYDLGGKMIDSILKEKVQSGDVITIDKATGKITRLGRSFARARDYDATGQQTRFVQCPEGELQKRREVVHTVTLHEIDVINSRTHGFLALFSGDTGEIKPEVREQINGKVAEWREEGKAEIIPGVLFIDEVHMLDIECFSFLNRALENEMAPIVIMATNRGITKIRGTNYKSPHGIPLDLLDRTIIVPTTPYDEKELKEILSIRCEEEDCQMSDNALTVLTRISKETSLRYGMQLIMTSSLIARKRKAHEVDVEDIKRAYQLFFDEGRSVQFLKEYQQEFMFNEMEGEDKMDVN

SEQ ID NO: 10979 - protein, 389 aa, Sitophilus oryzae
  misc_feature (363)..(363): Xaa can be any naturally occurring amino acid
MSLRTYGDKPISFQLEENGEYYCVGSEVGNYLRLFRGSLYKRYPGMFRRAITNEERKKLIDLGLSQHCLASSVSLLRATEVEDIIEGNDDKYKAVSVHTSDPPLPREGKSKKNLQWVPSLPNSSHLDAVPQATPINRNRVAAKKVRTFPLCFDDTDPQLNQENGCQHELLVPIRLDMEIEGQKLRDTFTWNKNESLITPEQFAEILCDDLDLNPLTFVPAIAQAIRQQLEAFPNEPPSIIEENSDQRVIVKLNIHVGNTSLVDQVEWDMSEKQNNPEDFALKLCSELGLGGEFVTAIAYSIRGQLSWHQRTYAFSEAPLPTVEVPFRTPSESDQWAPFLETLTDAEMEKKIRDQDRNTRRIRXKRSRQKYQKNTTIGQYYPRLVKNIII

SEQ ID NO: 10980 - protein, 233 aa, Sitophilus oryzae
MFCCWAPQEDFGKGPMAAIRKKLVIVGDGACGKTCLLIVFSKDQFPEVYVPTVFENYVADIEVDGKQVELALWDTAGQEDYDRLRPLSYPDTDVILMCFSVDSPDSLENIPDLSYPDTDVILMCFSVDSPDSLENIPEKWTPEVKHFCPNVPIILVGNKKDLRNDPTTINELRKMKQEPVKPQDGRSMAEKINAFAYLECSAKSKEGVREVFENATRAALQVKKKKKHRCILF

SEQ ID NO: 10981 - protein, 1281 aa, Sitophilus oryzae
MPLALSNLTQIKTINNVPLPPEIVDHFSHVQCHCMMGIFPDINRAWLTVDSDIYIWTYEENTDLAYFDGINETILCVGLIKPKPGVFHAFIKYLLVLTTAVDIVVLGVTFTEGSTSGLEEIQLISDPVFTLPTDGNTITTIAATANGRLFVGSKEGSLFEISYQAESGWFGKRCKMINLSTSALSFLVPSFLNAALSEEDSIVQIAIDDSRNIMYTLTEKGSIEVCDLGEKCNTFSRISKMTQNTLVTQAMNTVKTLDSQNFRPIISISPIESYESANLNLVAVTQTGVRFYLSVVGLSNQQPNQRPYTLTLAHVRLPPGYSANVTVRPRSVHMSHYRDRNLILISNVKDKDVLWCLSSDLFPFSQSLMEAYTTVNLDGPALALAEVRHNNYLQISPDQQEAPPLVVRQHGEAPKKYVVLTSHSVQIFIKLRPVDLLRQILRDSHGQDTEALRAFFMIQKESQACATSLILASLESEENAEIAELATRAFFMFGGEPKISPLNQTNVFSGTTMFSPNIISTPAPPQYQQSGFLPQSPGGAYSQSGYLQGSFSQSIPQQTFDPANLISYSNKHNGLYLYLGRILRPVWNRRCVERICPDGKTVLNQSTITVEDCVQILNNLTALHNFLSLNTQLSTTYNASTQYNSTIKANSLTTSHMNPTPQDIQVEERHSLDALKTFVCHCCQIIGLWRILCDHQFHELVGSLPENQQQILQSITFKELFLYRQDICSVLITTLVNSYLGDNASVDSISNKLIEVCSHLYNTENAEISKASELLKTTRTIQNTDEKEEMLVSALQLCKNIAPNVNLPEVCKQFTTLKAYKAVIELCAFCAHKLDPDNIGGNFYNSDDNAGDQEGFSYYQRRMEIYREIVVMLETLYNEQEPIVKQNFEPDYSNSKSVLLEGMGETKLDTTLHQIIDEILFYDDELMHIALYEWMVSKQMTNDLIKIGKPSLENYLKRTSIQTPDNIAVMDLLWKFYESNNNHAAAAKILNNLASRTGHSVTLKERIVYLARAIMCMRSDKVGYAPYLGVFLRDLEDKMEVAKVQELILDQITNMRDQIPNSKEAIAALNSGLYEISQLYENFAEPFSLLECQLAIIDCAGYTESDNALVKSIWQQILANELRKSSGSGTDRMSQVLSKVKHLARQYINSNNCFPLAYIVGELEMVNAKLKGDKHLVSTMLASVNIPFERLIQVYNHLITLSVNLDFWQSEENEFHLSEATAALITCFLNNHDSFNSVEKRKITAICQDTVAALLSNLYSKANSDHVVNRIRSIQAKLSRI

SEQ ID NO: 10982 - protein, 128 aa, Sitophilus oryzae
MSEFTLSYREVTPDQALYEKWIEITLHTGGTQSTLQDIKITERANGYSYLDSTRHYTRNRFIYWRISSDTLELIEQSLDINLTGNTVRYRFMDSPIIDGISVQETEENVIILVPTVCSVHMLRFPHPS

SEQ ID NO: 10983 - protein, 988 aa, Sitophilus oryzae
  misc_feature (676)..(676): Xaa can be any naturally occurring amino acid
MEISDENLRTLGKYLFETLNADVTVRRTAEKFLEGVEVNQNYPLLLLHLVHQPETDMLIRTAGAIAFKNYIKRNWTVVEDQADRIHESDRTSIKNLIVTIMLTAPDNIQKQLSDAISIIGKTDFPTKWPQLITEMVEKFAIGDFKIINGILRTAHSLFKKYRYEFKSNELWTEIKYVLEKLAKPLTDLLVATAGVISANASDIVASQLIFSSLVLIAKIFYSLNFQDLPEFFEDNMEVWMNHFHALLNIEQDTLETPGIDEPGVLQMLKSQICDNVALYAQKYDEEFQKYLPQFVEDVWSLLSKTGLQPKYDLLVSNALQFLSTVAERTHYRNLFENPSVLSSLCEKVVIPNMEFRVTDEELFEDNPEEYTRRDIEGSDVDTRRRAACDLLNTLSIQFEPKIMEICGQYLQVMLSKYVENPKTNWRNKDTALYLVISLVSRGSTQKHGVTQTSQLVNISQFCQQQILPELERPDVNELPVLKADAIKYIMTFRSVLPNEVVVSTLPQLIRHLQSESAVVHTYAACAIEKILIMKDSNNQAIVSGGHIQPFAKDLISQLLEVLERPVSEENEYIMKALMRTFSTLQELVIPYLGVALPKLTEILKAVTKNPSRPHFNHYLFETFSLSVRIVCKSNQAAVKSFEDILFPIFQGILQQDVQEFIPYVFQVLSMLLDYTXQEFIPYVFQVLSMLLDYTPSGSLSDAYMQLLPCLLAPVLWERPANISPLVRLLRSLVSQAAQQIIAQDKLPGFLGVFQKLIASKTNDHEGFYLMQALILHCPKECLQPYLKQIFFLLFQRLSSSKTTKYVINVIVFFSLFIIKYSASDLITMIDGIQDQMFGMVLEKLFIAETQKVTGQIERKIVSCGITKLLCESPEMYTGKYAKYWNQLLQALLMFFELPPDESTFPDDHFIEVDDTPTYQTSNAKLNFANADKEDPVAGLGEPRQFLVQSLATLGASQPGRLPTLISNTAPQSQTVLQTYLAKFGVQLV

SEQ ID NO: 10984 - protein, 211 aa, Sitophilus oryzae
MAKVQLCNITVMDNPSPFLNPFQFEITFECIEELKEDLEWKMIYVGSAESEEYDQILDSVFVGPIPEGKHMFVFQADPPNVSRIPENDALGVTVVLLTCSYRAQVLTCSYRAQEFIRVGYFINNEYNDPELRENLPSPPQFDKVTRNILASEPRVTRFKINWEEPNAQEVVSNLENTENSSITTEQSNNATQSQIPSFNDNSNSWATMECS

SEQ ID NO: 10985 - protein, 325 aa, Sitophilus oryzae
  misc_feature (276)..(276): Xaa can be any naturally occurring amino acid
MDQMLPSPGFSIPSIGTPLHQPEEDQQILPNALQQQQQSQPATSQVPSLAPMGGLTPTLGLGMGNAMSMPHTKYVTAYQMPMSTMHSGMTPQTPQHTMMSPMVNLGGSGGSGATPNVGGPATPSPMTPMTPHSADPGIVPQLQNIVSTVNLNCKLDLKKIALHARNAEYNPKRFAAVIMRIREPRTTALIFSSGKMVCTGAKSEEDSRLAARKYARIIQKLGFPAKFLDFKIQNMVGSCDVKFPIRLEGLVLTHSSFSSYEPELFPGLIYRMVKPXGLIYRMVKPRIVLLIFVSGKVVLTGAKVRQEIYEAFDNIYPILKSFKKQ

SEQ ID NO: 10986 - protein, 158 aa, Sitophilus oryzae
MAAIRSMSRLLTSRSLSSTAKRCYSEEMNFTFASGNQIFYDGKSVKQVDVPSFSGSFGILPKHVPTLAVLRPGVVSVYENEGAVKKIFVSSGTVTINDDSSVQIIAEEAHPVENIDLSAARDLLSKAQSQLSSAANDQAKAEAEIAIEVGEALVKAAE

SEQ ID NO: 10987 - protein, 329 aa, Sitophilus oryzae
MSGDGNKTDQFDTLFLSIAQHHPEGAHQLLDTFVGFLGRKTDFFTGGNEGDWEKLVMNTFKKHEKISRSRHDAEVKERKDREAAKKAKKAEAEAVKPAEITELTDEEADRLQKEIDKKKGIDAVPSVINNEESNPSTSASSAEKIEEDEDESEKGKLKPNKGNGCDLERYKWTQTLQDIELRVPLEINFRAKQKDLVVNLAKKHLTCGVKGQPPIIDDDLQHEIKLEESTWVIEDGKVLLFNLEKVNKMNWWGKLVQSDPEISTKKINPEPSKLSDLDGETRGMVEKMMYDQRQKEMGLPTSDEQKKQDVLKKFMEQHPEMDFSKCKFN

SEQ ID NO: 10988 - protein, 152 aa, Sitophilus oryzae
MATYSGAPPVLQWSPDKKFSDRERWICIYPAYINSKKSIAEGRRIAKSRAVENPTYQEIRDVLVASGLNVGVENKQYSRERSKELLCRGRIRVQLKHDDGSLYNSSFPTRDSVLLHLGDMIPKLKTRLSKPSGEQQPQSSQGKGKGKGKGRR

SEQ ID NO: 10989 - protein, 710 aa, Sitophilus oryzae
  misc_feature (401)..(401): Xaa can be any naturally occurring amino acid
MEGKAQKMPKVAKVKNKAPAEIQITAEQLLREAKERDLEILPPPPKQKISDPAELADYQLRRRKQFEDNIRKNRTVISNWIKYAQWEESQKEIQRARSVWERALDVDHRNITIWLKYTEMEMRNRQVNHARNLWDRAVTILPRVNQFWYKYTYMEEMLENVPGARAVFERWMEWQPDEQAWQTYINFELRYKEIDRARSIYERFVVTHPAVKNWIKYARFEENHGFIHTSRQIFERAVQFFGDDHMDERLYIAFAKFEEGQKEHDRARVIYKYALDNIPKDQTKELYKAYTIHEKKYGDRSGIEEVIVSKRKFQYEQEITENPTNYDAWFDYIRLVEGEGDVEIIRETYEKAIANMPPTRNKDYWRRYIYLWINYAFFEELEAQDYERTRQVYKACLELLXWRRYIYLWINYAFFEELEAQDYERTRQVYKACLELLPHKIFTFSKIWLLFAKFEIRQKNLTAARKILGTSIGLCPRDKLFRGYIDLEIQLREFDRSRKLYEKFLEFGPENCVTWMKFAELETLLGDIDRARAIYELAVNQPRLDMPELLWKAFIDFEISQDESDNARQLYERLLERTTHVKVWLSYAKFELNQQTDDGLNIRLARRIFERGNDNLKNSVEKESRALLLENWKEFELNHGDESSQATINSKLPKRIKRRQKVVDEDGNEQGWEEIFDYIFPEDESSKPNLKLLAAAKSWKKSAAVQDEAV

SEQ ID NO: 10990 - protein, 476 aa, Sitophilus oryzae
MGIKFLEVIKPFCSILPEIGKPERKIQFREKVLWTAITLFIFLVCCQIPLFGIMSSDSADPFYWIRVILASNRGTLMELGISPIVTSGLIMQLLAGAKIIEVGDTPKDRALFNGAQKLFGMVITVGQAIVYVMTGMYGDPAEIGAGVCLLIIIQLFVAGLIVLLLDELLQKGYGLGSGISLFIATNICETIIWKAFSPATVNTGRGTEFEGAVIALFHLLTTRQDKIRALREAFYRQNLPNLMNLLATVLVFAIVIYFQGFRVDLPIKSARYRGQYSSYPIKLFYTSNIPIILQSALVSNLYVISQMLAVKFQGNILINLLGVWADVGGGGPARSYPIGGLCYYLSPPESVGHILEDPLHALLYIIFMLGSCAFFSKTWIEVSGSSAKDVAKQLKEQQMVMRGHRDNSMIHELNRYIPTAAAFGGLCIGALSVLADFLGAIGSGTGILLAVTIIYQYFEIFVKEQSEMGGMGALLF

SEQ ID NO: 10991 - protein, 158 aa, Sitophilus oryzae
TNTSPSIDLSSYRDQHFKGTRAEQDKLLRLSTTLYVGNLSFFTTEEQIYELFSKCGDIRRIIMGLDKYKKTPCGFCFVEYYTRPDAENCLRYVNGTRLDDRIVRTDWDAGFIEGRQYGRGKTGGQVRDEYRTDYDAGRGGYGKIIQQKIGTEVPAFLR

SEQ ID NO: 10992 - protein, 313 aa, Sitophilus oryzae
MAATVGRVCGAGLLKSKTGPCLSQISSYSTTREWSRGKKALLGSLGVIAGGAGALIIALDKSVRASELILHPPKNPWSHNGWFNGLDHASVRRGYEVYKQVCAACHSLRYVAYRDLVGVTHTEEEAKAEAEEQLVTDGPDEAGNMFQRPGKLSDYFPSPYPNEEAARAANNGAFPPDLSYIVPARHGGEDYIFALLTGYYDAPAGVVLREGQYYNPYFPGPYFPGGAISMAQALYNEVIEYADGTPATASQLAKDIGTFLKWTAEPELEDRKIMTIRAIGIFSILIVLSYYAKRFKFASLKTRKIEFKPKEKK

SEQ ID NO: 10993 - protein, 574 aa, Sitophilus oryzae
MLSLQAYNSSSDEESDQTAVQEKSNGTPYETLPPELQKFSSKKDLQVCATPVVLPPAIDEDKIHIHPDTSELQYNPKYDELFAPVVGPVNPFKTQQQAIERNILSGHIEPAHVSEFQFENQRRTFASFGYALDPSVSTTEKELHKVIGGSEETPDSDMKTVFENTKLRPLDKRKRKKNDDPSDVEGFLGPWGGFVGEQRVMKPTEEEQAELQELVSKRNRRGKEVEEKQFEEKSVLHIKDAVDYQGRSFLHAPQDVGVNLKSDTPPEKCFLPKAHIHTWSGHTKGVSAIRWFPKTAHLFLSCSMDSKIKLWEVYNERRCIRTYYGHRQAVRDINFNNSGHHFLSAGYDRYIKLWDTETGRVISRFTSRKIPYCVKFNPDHNKQHLFVAGTSDKKIICWDTRSGDIVQEYDRHLGAVNTITFVDENRRFVTTSDDKSLRVWEWNIPVDMKYIADPTMHSMPAVTPSPNGKWLACQSMDNKIVIFSALNRFKLNRKKTFTGHMVAGYACQLDFSPDLSYLVSGDADGKCFIWDWKTTKLYKKWKAHDGVCIGSLWHPHEPSKVMTAGWDGLIKYWD

SEQ ID NO: 10994 - protein, 276 aa, Sitophilus oryzae
MVQKKPKKKVGKKVAAAPLVVKKVEPKKEVNPLFEKRPRNFGIGQDIQPSRDLSRFVKWPKYIRIQRQKAVLQKRLKVPPPINQFTQTLDKQTATQLFKILEKYRPESIIQRNERFKAIVDSRKQDKEYVPSKRLFVRFGTNTVTKLVEQKKAQLVVIAHDVDPIELVLFLPALCRKMGVPYCIVKGKARLGVLVRRKTCSTVALTQVDSGDRSSFNKVVEAIKTNFNDRGDEIRRHWGGGLLGSKSSARVAKLERAKAKELAQKQGGGDQDQLQR

SEQ ID NO: 10995 - protein, 334 aa, Sitophilus oryzae
MALLLKDIKLGDNIVKKVLFEKHIDFINDYGQDENNYDYGMTDYLRVSGMYWGLTLTALELMNSEPVQGKDKIVEYIKQCQDPQSGGISACIGHDPHILHTLSAIQILVMYDRLAAIDIEGVVRYIQGLQQADGSFAGDKWGEIDTRFSFCAVNALSLLKKMDVIDIEKAVEFVASCKNFDGGFGSRPLSESHAGLIYCCVGFLSITNRLDIIDQDTLAWWLCERQLPSGGLNGRPEKLPDVCYSWWVLSSLAILGRLHWIDTEALKTFIFACQDTETGGFADRPGDVADPFHTLFGLAGLSLLGYDSIQKVNPTYCMPQHVIDKQELKPQRLN

SEQ ID NO: 10996 - protein, 893 aa, Sitophilus oryzae
MHQEAIQLIQVLEKTISPDKNELEQASTFLEQAAATNVLGFIKTLSDILRHGGNSPVARMAAGLQLKNHLTSKDPNIKVQYQQRWLSFPEDIRSYIKKNVVGALGTETNRPSSAAQCVAYIAVTELPQRQWPDLISTLVNNILNATSEMQKEATLETIGYICQEIDCDVLVSQSNDILTAIVHGMRVTETSSHVRLAATQALLNSLEFTKANFEQPTERNYIMEVVCEATQSADTQIKVAALQCLVKIMSLYYQHMETYMAPALFPITLEAMKSENDAVALQGIEFWSNVSDEEVDLAIEDTEAQEAGRPPSRVSRHYAKGALQFIVPILLQKLTKQEELDDEDDWNPSKAAGVCLMLLATCCEDEIVPHVLPFIKDNIKSDNWRFRDASLMAFGSILGGLESNTLKPLVEQAVPTLIELMYDSSVMVRDTAAWTFGRICEIIPDVAINETFLKPLLESLITGLKAEPRVAANVCWAFSGLAEAAYEAATCDLVGEETTPETYCLSPFFEFIVQRLLEATDRPDGAQANLRPAAYEALMEMIKNSPRDCYVTVQKTTMVILDRLQQVLQMESQISSHSDRSQFNDLQSLLCGTLQSVLRKVTPEDAPQISDAVMTALLTMFNSHKTGGVQEDAIMAVSTLTEVLGDGFLKYMDAFKPILYLGLKNHQEYQVCGTAVGLTGDIFRALKIKALPYCDEIMTLLLENLGEPTVHRSVKPQILSVFGDIALSIGTEFKKYLDIVLATLAQASQAQVKVDRTDYDMIDYLNELREGVLDAYTGLIQGLKGDSNTPSGDISLLEPHIPFIIQFITVVAQDSEHSDGTMAVAAGIIGDLCVCFGAPMLPLLDLEPINEMLSQGRRSRVQRTKGLCNWATKELRKLKSQQGGQTTAPAASW

SEQ ID NO: 10997 - protein, 500 aa, Sitophilus oryzae
METILEQQRRYHEEKERLVDTMTKEMLQKKISYREQINSDHRMKYLLDRYMTSTNRLIDLYEDKDGQRKAEVAALTGPNEFNEFYSRLKQIKDFYRKHPNEISVPMSVEFDELTKARENPSEEMSNLVEFTDEEGYGKFLDLHECYEKYINLKGIEKVDYITYLGMFDQLYDIPKERKSGEYRKYLLCLIEYLSWFVQRIKPLTDLDAILEEEVNNTLPQWENGNCPGWPKETGSALANVGAHLDLSAFSSWEELASLGLDRLKSALLALGLKCGGTLEERAQRLFSTKGQSSLDPSLMTKSTKGKASKDKELLRHRELAMLEAQIYKLADIVSPQRGATKENVQRKQARTDGERDDSENEESEDDSPDENDDDVPYNPKNLPLGWDGKPIPYWLYKLHGLNISYNCEICGNYVYKGPKAFQRHFAEWRHAHGMRCLGIPNTAHFANVTQIEDALALWEKLKVQKQAERWQPETEEEYEDSQGNVVNRKTYEDLKRQGLL

SEQ ID NO: 10998 - protein, 210 aa, Sitophilus oryzae
MTIGKNNKMIQHINYRVRITLQDSRTFIGTFKAFDKHMNMILGDCEEFRKVKPKNSKVEREEKRVLGFVLLRGESIVSLTVEGPPPPEEGLPRVPIPGATPGPGMGRAAGRGMPAGMSGVPVGLQGPVRGVGGPSQQVMTPGGRGQVSAPPQMNHGPPRMGIPPPGMMGGPPPGMMPPNAMGMGRGGPPPMGMRGPPPGMMRGGPPPRGY

SEQ ID NO: 10999 - protein, 331 aa, Sitophilus oryzae
MSVRSFDELYGLLREDLQKNNTNMRVAIGPIERLVIPLRYLATGADFAALEYVFQVSKSTIRLIVRQTCVAVWNKMQPLEMPQPDAELWTKIAEEFYRKSNFPNCLGAIDGKHIRLVCPPNTGTQYFNYKKYFSIVLLAVSDADYCFTAIDVGAYGREADSNIFKSSVFGRRLAQKNLDLPGNRPLPNTPNISLPHVFVADEAFGLGENVMRPYARNNLSIEKRVFNYRLTRARRYVECTFGILANKWRVFHTNILVSEDFATDVTKAACLLHNFVRRRDGVESNDESSCLMENIPAIGTGGPSAGIAIREKFKDYFVSREGELLYQYDKV

SEQ ID NO: 11000 - protein, 192 aa, Sitophilus oryzae
MQGRTKKYNILNITDSAESPDQDATTEPSTEPEDEELTQPFEESEVVVIDQPVKSPEEQISTKEDFEELIDEGSRKEKLMKPDPKQIADFHKYAAPTNVFSFPPKAQATIRPANVIGPNTKMPQKISLITTPIIQNFTNRSDGSKPTLETQQLILTPTTKINTTAASKLSSHHIILTHNPVRSNIISVGPKI

SEQ ID NO: 11001 - protein, 688 aa, Diabrotica virgifera
MERSRKQRDQSISNSSEDSNKKKQYSKHSKGKEKYRDTRDRSSDKSKEKRKKSKKKKKRSRSSSEESSSNSDSSDNSVKLLEKLTKERIRLGEERKKQKELIKATETAEEKRMRRLVKKENKERSRKERMGWDNEYLHYTNSDNPFGDGNLLSTFVWSKKLNKEGLKGVSQEEIEAINRMKQEENKRELEKVKKRRLERELERQKRDEETQMLQRSKEAAQFEEWERQEDKFHLEQARLRSHIRIQDGRAKPIDLLAKYISAEEEVDAVEMHEPYTYLNGLHIKDLEDLVEDIKVYKELERGKNLDYWNDITVIVEDELQKLRKLEKQNDFDLGLNRREGIHQSVAGDVTSVFKGKTAVQLAALEKQIEGKISGKADGIDIGYWESLLSQLKAHMARARLRDRHQESLRRKLQVLKAEQAIIVTAPSESHSSGGEEAPTKDVQEPKPGPSQEPGDKENNEEEPADEEAANSWLNECFDAYEAGGYSPKFLTPDEIEPGTIVVIEEDDLKRLEFARIQVVGKGKTVENVITKEELMLQKEARKGMDGDEAQFSVEQALDSQVYLWSDKYRPRKPRYFNRVHTGFEWNKYNQTHYDMDNPPPKIVQGYKFNIFYPDLIDKSSTPEYFLTPCPENKEFAILRFHAGPPYEDIAFKIVNREWEYSYKRGFRCQFHNNIFQLWFHFKRYRYRR

SEQ ID NO: 11002 - protein, 420 aa, Diabrotica virgifera
MDNLETNIMDKSMRSVFVGNIPYEATEEKLKDIFGEVGQVLSFKLVFDRETGKPKGYGFCEYRDQETALSAMRNLNGYEIGGRNLRVDNACTEKSRMEMQNLLNQPPVENPYGEAVQAEKAPEAISKAVASLPPEQMFELMKQMKTTIQNNPTEARQMLLQNPQLAYALLQAQVVMKIIDAATAVSLLHPVNQVPATLMPGDKNVPVQVPVNNQYREPPAPVQPPVHPRQDFQPVPPPVMHPSQNQVFPSQDIDLRSIGGVPDLRNLRPMGDQDMRQMPSAIQNPLPPTIGESFIRDPRAAQAFAGDPRQARMDPRQKPMVPPPQSQMPIPPPIARPPVMPPQPQVPVTRAAPPPQPSPAPTPATASPNVANAGASDQEKAALIMQVLQLSDEQISMLPPEQRNSILVLKEQIAKSAHTR

SEQ ID NO: 11003 - protein, 392 aa, Diabrotica virgifera
MTQMDPEREKSLQEYRKKLLEHKEVESRLKEMREQLKDLTKQYDKSENDLKALQSMGQIVGEVLKQLTEEKFIVKATNGPRYVVGCRRQLDKAKLKAGTRVALDMTTLTIMRYLPREVDPLVYNMSHEDPGDVTYSAIGGLSEQIRELREVIELPLLNPELFMRVGITPPKGCLLYGPPGTGKTLLARAVASQLDANFLKVVSSAIVDKYIGESARLIREMFNYAKDHQPCIIFMDEIDAIGGRRFSEGTSADREIQRTLMELLNQMDGFDSLGQVKMIMATNRPDTLDPALLRPGRLDRKIEIPLPNEQARLEILKIHALPIAKHGEIDYEAIVKLSDTFNGADLRNVCTEAGLFAIRAEREYVIQEDFMKAVRKVADNKKLESKLDYKPV

SEQ ID NO: 11004 - protein, 258 aa, Diabrotica virgifera
MARRYDTRTTIFSPEGRLYQVEYAMEAISHAGTCLGILANDGILLAAERRNTNKLLDEVFISEKIYKLNDDMVCSVAGITSDANVLTNELRLIGQRYLFQYAESIPCEQLVSWLCDVKQAYTQYGGKRPFGVSILYMGWDKHYGYQLYQSDPSGNYSGWKATCIGNNSSAAISSLKQEYKEGQMTLKDAKTLAVKVLAKTLDMAKLTSEKVEMATLTRKNDKTMIKILSGKEVEELISEYEKSEAAAEASKKEQKASA

SEQ ID NO: 11005 - protein, 889 aa, Diabrotica virgifera
MGDTKVEPTKVDKTKGTEDKNKNELSEEDKQLQDELNLCVEKLQDNDEKRYLLALQALSNHIQASTTSMTSVPKPLKFMRPHYETMKTVHEKITDPDTKKVCADIISVLAMTMGEGRECLKYRLLSNLDKIGEWGHEYVRHLAGEIAGEWAETDFIVNTEIREKLILLTKQIVPYNMAHNAEAEACDLLMEIERLDLLEQYVDENIYHRVCLYLTSCVPYVADPENTTLLQTALLLFRKFDQYPQALRLAMQLNDFGLIEEIFVNCPDSDVQKQLAFMLGRQQIYVEIPEHTPEYEDLIEIMANCHLNNHFLNLARELDIMDPKTPEDVYKSHLENSRPPFGGNQVDSARQNLAASFVNGFVNAAFGQDKLLMEDGNKWLYKNKEHGMLSATASLGLILLWDVDGGLTPIDKYLYSSEDHIKSGALLACGIVNCGVRNECDPALALLSDYVLHNTNIMRIGAIVGLGLAYVGSNREAVLSLITPVLSDPKSNMEVIGMAALACGMISAGSGNSHVTTSIMQVLMEKSEIELKDTYARFLPLGLGLCHLGKQESIDTIIAALEVIPDPFRSMATTMVDICAYAGTGNVLKVQHLLHICSEHYDAPETPDKTSKDKDKKEAEKEKDKDLSARQAIAVLGIALISMGEDIGSEMAFRTFGHLLRYCEPAIRRAVPLALGLISVSNPKLSILDTLSKFSHDSDAEVAHNAIFAMGLVGAGTNNARLAAMLRQLAQYHAKDPNNLFMVRIAQGLTHLGKGTLTLSPFHSDRQLMSPVAVAGLMATLIGFLDVKNIILGKSHYLLYTLAAAMQPRMLVTFDDELNPLPVPVRVGLAVDVVGQAGKPKTITGFQTHTTPVLLAYGERAELATEEYIALTPIMEGFVILRKNPEFNS

SEQ ID NO: 11006 - protein, 518 aa, Diabrotica virgifera
MTDNEMDSKDEQKPSPEEVKPKIDTSDTDSQPPQISVTSGGGVIRRNFITTAGTIVETNEEQPPEPTTEEIVNTENSTPQEQSPVEHKIEPTETTTYQDLRMETHQREQFTEPKQYTVEMPAESFSGQNFSQDIGYTSNIATVNIEGNEVPITISSEIDQPGGDYTSLQTAQYNNGYTDGPQYLQQHQYQNLYVDRGSVENSPPATLLFKDDPNLATARYPTNYDVSSSQSQLNLLPNDTYFTTTANWASTSTGSYQQQYSNTINILHQADSTQSYGGGPYVNTAWSSSPMEDGRPPSQEVLVKECVNCGASVTPLWRRDGTGHYLCNACGLYHKINGVHRPPIRPSKKPQATGNRRNGVSCANCKTNNTTLWRRNNQGEPVCNACGLYFKLHGVNRPMSMKKDGIQTRKRRPKNSGGNPGPSGQVRLGNIYQYQHAPELEIQQDTYQLPINVYPSPTQGPYRQYAAENLRGLNAQPLQPIITTDDEQTSVITSTSQQARFRVDTEEDDGSNNPPANA

SEQ ID NO: 11007 - protein, 1635 aa, Diabrotica virgifera
MALPGNGIFVVKGEISNMMAAMKRGTRWSSHSYQDDDVDSLLRNFQELRDILDNVDDLRFVEPNTFLAPFLNVIRSEETTGPVTSLALSAVNKFLSYGLLDPLHASIPQTIHSIADAVTHARFVGTDQSSDGVVLIRILQVLRTLTLSPEGTALTNESLCEIMLSCFRICFETRLVDLLRKTAEHYLKEMVQLIFMRLPQFSEDLKVSYIKQLKMKPGALDQTRTKRKKQYSSLKKDKSDTDIKSPQTPQGNLAAVAQSSIVDMQGSLQNPENANPVTSNASPKENFKCDVDIIVDSPVSNNEDLKNIDSISSGVEEAATEPKSLTEEEITEEQSPSTQDYINQRGIRFTPQLQQEANLSPYGLACVRELLRFLISLCNPLDKQNTEIMIHLGLTLLTVAFEISADNIGKYNTLLALVKDDLCRNLFSLMNTERLAIFSLDLQVSFLLFESLRTHLKYQLEHYLKKLIEIILSDSPKVTYEHKEIALDNLLQLWRIPGFHTELYINYDCDMYCANLYEELTKLLAKHSISSNTGVYHTHLLSLDALMIITEGIENRCCEEKDRLDAGNSELVQQSNDISFYVGKNSRTKVSPIMPKKEELAQKKSIKKWLPQGTEYFNKKPKKGIEFLQEHGVLKQDIDLDEIARFLRENPVLNKAMIGEYISNRSNLKILQSFVDTFNFVGVRIDEALRAFLETFRLPGEAPTISLILEHFAETWHKANNEPFADVDSAFTLAYAIIMLNVDQHNENAKKQTTPMSANAFKKNLKGVNGGNDFDEEMLDDIYTTIKNEEIVMPAEQAGLVRENYFWKILLRKGQTKDGIYIHDNSGTYDSELFQIVYGPIVAALSSVYEKAENESVHKKVMQGFERCAFIAANLNISTNLDMLILGICKFTVFYNQQKQNNIVVQFGMNSKAQLALRTVFSLIHQHGNTMREGWKHLFDLLLALYSNGLLSKTFVEVEDFIEPSGKLMLVYKEAPSAAKQDTGLLSSLYSYMVSAENLSKIPTPEEQNCIDAAKECIKDCNLEQMITDSKFLHEEALFELVKTLIELSRGPDVHESVAYDYNDNVTVFFLELLIKVVIQNRDRVMTVWQNVRDHIYTLVMNASVFDFQFLLERSVIGLLRIAIRLMRNEEMSHIVLQSLRMLLLLKSSTLSRISRQISFGLYELLKTSAQNIHTNTDWTIIFTLLECVGAGAQPPKPVSSAEDTELKSKSDGETSDNHEEEGTLSDSEGRKSPKDNTQRSQSPVSVVTSPVGTPNTGGWILVGNEGEIQPVMGRTVPPTQYGLALEKNLGSHDPRSMMKCCESLAFLVRDVAHITPYNFDVCVHCIRTFVEASLHGSNFKRLRDSRSRKKTLDRTRTRKSPTSSPDEEDSDDENIPSGYHQISIQLLDLMHTLHTRTAQIFKWWAEEGGEISQETSLWTQGWCPLLQGIARLCCDTRRPVRMSAITYLQRALLVHDLQTLSGSEWEQCFQRVLFPLLSYLLQSINPKDAISMEETRIRVATVLSKVFLHHLTPLLALPSFFNLWLVVLDFMDKYMHADKSELLYEAIPESLKNMLLVMDSAKVFDGPDGKNILWNATWERIGKFLPNMKDDLFKEIEDQNRKNEEVSNIEIIVNKEEKDVNTEKLTTNDNLITC

SEQ ID NO: 11008 - protein, 205 aa, Diabrotica virgifera
MSILAYNGGAMVAMKGENCVAIAADRRFGIQAQTVATNFQKIFEMGPHLYVGLPGLATDTQTVMEKLRFRKNLYELKENRKISPKVFASMISNMLYEKRFGPFFVEPVVAGLLPNTYEPFICNMDLIGCINQPSDFVVGGTASAQLYGMCEALWEPNLGPEDLFETISQALINAFDRDAISGWGATVYIIEKNKVTVKNLKTRMD

SEQ ID NO: 11009 - protein, 935 aa, Diabrotica virgifera
MDQKPDLDLVISAVSALYNNPNSSEKERASKWLLELQKSVHAWTVADELLHLKRDLESCYFAAQTMRTKIHQSFHELPLEVHTSLRDSLLEHIGQINEATNTVIVTQLCVALADLALQMPSWQNPTLDLINRFSQTNIWPLLEILTVLPEELESRSVRLGENRRIDVLEEMKISAPTVNEFLKHCSKLYETNWQEHVQFNVKVLRCFTSWISVGAISLNDLSDSIVINRAFEILNFKPQNDKHTISAAFHEAATDCICTLLLSLENNNNQLGLENYLFNNIINLDVPYHLSVANEDQGKSMDYCRLFTELAESFLEKIIANSNTKQMHYAIKILDLVLMCVGHHDYEVAEITFNLWYVLSEELYQKNNKEKTELFRPYVERLITALCRHCQMEPDSEGLLEDGDEFKDFRLKVAELIRDVVFIVGSSACFKQMFINIQGPGVMWDSTEAALFVMQAVAKNVIPGESEVVPQVVEAILNVPENTHVAVKYTSVLLLGELCEWIERHPNTLDPVLNFLVCCLPQPGVGAAAAVALQNICASCNDHMPRHVPILLQLLHQADSFAITNTATLGLLRGVASIIGRMPHEELTTALRELCSMQLNPICQIIEQDVHPVKGAQTDPVMWLDRLSAVLRYVNVHIPEGVENPCKPVILEVWPVLSRTFDKFQSDIRIMERCCRAVRFMLRCVAQEVRELLESLVGQIVRIYTLYQHSCFLYVGSILVDEYAIDPICVPGLLDMLQAFLEPTFHVLQEENGLKNHPDTVDDFFRLCARFMQRAPLAFLKCSSLVHILQCALLASSLDHREANMSVMKFFYDLINQGQSGRADPEFNQRQMLVKSILDEYGQQLVSNLIHSCVFYLHSYMLSEVGDVFVQLLDFDREITCKWVAAGLDVLPKNSTGGIMAATPQQLTDIHTTISRSNTSKSVTHALKDLARLYR

SEQ ID NO: 11010 - protein, 501 aa, Diabrotica virgifera
MAQRFPGPVPNQSPGGPPPQRYQQQPPNQGIRQYAQQNFPQRPGYNPPPPNIPSSGGTMIQRPAGAPYSPMRGGIIPPQQGNKRPADNRTQMQQKSNEYSHSTSKKKKKLADKILPQKVRDLVPESQAYMDLLAFERKLDSTIMRKRLDIQEALKRPMKQKRKLRIFISNTFYPAKEPQPEGPDGPCQEGTVASWELRVEGRLLEDPKNDPNKVKRKFSSFFKSLVIELDKELYGPDNHLVEWHRTLTTQETDGFQVKRPGDKNVRCTILLLLDYQPLQFKLDPRLARLLGVHTQTRPVIISALWQYIKTHRLQDAHEREFIVCDKYLEQIFNCTRMKFAEIPQRLNPLLHPPDPIVINHVISVEGGAESKQTACYDIDVEVDDTLKTQMNNFLLSTASQQEIQGLDAKIHETVDTINQLKTNREFFLSFAKDPQQFIHKWIVSQTRDLKTMTDVVGNPEEERRSDFFYQPWAQEAVCRYFYTKVQQKRAELEQALGIRNN

SEQ ID NO: 11011 - protein, 144 aa, Diabrotica virgifera
MPKVRRSKKPPPEGWELIEPTLDELEQKMREVETQSHEGKRKNESLWPIFKIHHQKSRYIFDLFYRRKAISRELYDYCLGENIADKNLIAKWKKQGYESLCCLRCIQTRDTNFGTNCICRVPKSKLEEGRIVECVHCGCRGCSG

SEQ ID NO: 11012 - protein, 294 aa, Diabrotica virgifera
MPAATLGSIPHPNNEDCGIRDVWAHNLEDEFRTIRQIVQKYQYVAMDTEFPGVVARPIGEFRSSADYQYQMLRCNVDLLRIIQLGLTFLDDNGKTPGGAYTTWQFNFKFNLQEDMYAQDSIDLLQNSGIQFKKHEDEGIEPLEFAELLMSSGIVLVENIKWLSFHSGYDFGYLIKLLTDNNLPQDETEFFDLLKLYFPTIYDVKYLMKSCKNLKGGLQEVAEQLELERIGPQHQAGSDSLLTGMAFFKMKEMFFEDTIDDSKFSGHLYGLGTSFAVNGTANNYSNDNGDTTNSS

SEQ ID NO: 11013 - protein, 402 aa, Diabrotica virgifera
MAVPKRGASVFEDLSNVEFETSEDVEVIEKFKNMNLKEELLRGIFAYGFEKPSAIQQRAIKPIMKGRDVIAQAQSGTGKTATFSISILQALDLTMRETQVLCLSPTRELAVQIQKVILALGDFMNVQCHACIGGTNLGEDIRKLDYGQHVVSGTPGRVYDMIRRRALRTRSVKMLVLDEADEMLNKGFKEQIYDVYRFLPPSTQVVLISATLPHEILEITSKFMTDPIRILVKRDELTLEGIKQFFVAVEREEWKFDTLCDLYDTLTITQAVIFCNTKRKVDWLTEKMRENNFTVSSMHGDMPQKERDNIMKEFRSGQSRVLITTDVWARGIDVQQVSLVINYDLPNNRELYIHRIGRSGRFGRKGVAINFVKSDDIRILRDIEQYYSTQIDEMPMNVADLI

SEQ ID NO: 11014 - protein, 534 aa, Diabrotica virgifera
MTAPTAGGDTNRGRTVAYKDKSKPADVRTSNINAAKAVCDAIRTSLGPRGMDKMIQAGNGEVTITNDGATILKQINLIHPAAKMLVELSRAQDIEAGDGTTSVVVIAGALLDAAEKLLQRGIHPTAISESFQRAAQLAVDILSDISTPIEITNRELLIKSASTSLNSKVVSQHSSFLGPLAVDAVLKIVEPGREQACNLSDIKVIKQLGGTVEDTELVEGICFPQRSANVSGPKRIEKAKIGFIQFCISPPKTDMDHNVIVSDYAAMDRVLKEERAYILNIVKQIKKAGCNVLLVQKSILRDAVSDLALHFLDKIKCMVIKDIEREDVEFVCKSLGCRPIASLDHFVAENLVTADLVEEVGLAGNRMVKITGAQNAGRTVTLLVRGSNKLVLEEADRSLHDALCVIRCLVRKKALIAGGGAPEVEVALKLAAMANKLEGIDAICTRAYANALEIIPFTLSENAGLNPIQTVTELRNRHAKGETSAGINVRKGAITDILEENVVQPLLVSTSALSLATETVRSILKIDDIVNTFT

SEQ ID NO: 11015 - protein, 409 aa, Diabrotica virgifera
MEAMDIVIPEKEEGSPSEVKQVLQDVDTEDLYTKYKKLQQQLEFLEVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVQYSDIGGMDMQKQEIREAVELPLTHFELYKQIGIDPPRGVLMYGPPGCGKTMLAKAVAHHTTAAFIRVVGSEFVQKYLGEGPRMVRDVFRLAKENSPAIIFIDEIDAIATKRFDAQTGADREVQRILLELLNQMDGFDQTTNVKVIMATNRADTLDPALLRPGRLDRKIEFPLPDRRQKRLIFSTITSKMNLSEEVDLEDYVARPDRISGADINAICQEAGMHAVRENRYIVLPKDFEKGYKNNIKKDESEHEFYK

SEQ ID NO: 11016 - protein, 162 aa, Diabrotica virgifera
MPNIKLQSSDGETFEIDVEIAKCSVTIKTMLEDLGMDEEEEEVVPLPNVNSAILRKVIQWATYHKDDPPPPEDDDNKEKRTDDISSWDADFLKVDQGTLFELILAANYLDIKGLLDVTCKTVANMIKGKAPEEIRKTFNIKNDFTASEEEQVRKENEWCEEK

SEQ ID NO: 11017 - protein, 309 aa, Diabrotica virgifera
MDDKASCKELDGWIEQLNECKQLTENQVKTLCDKAKEILSKESNVQEVKCPVTVCGDVHGQFHDLMELFRIGGRSPDTNYLFMGDYVDRGYYSVETVTLLVALKVRYKERITILRGNHESRQITQVYGFYDECLRKYGNANVWKFFTDLFDYLPLTALVDSQIFCLHGGLSPSIDTLDHIRALDRLQEVPHEGPMCDLLWSDPDDRGGWGISPRGAGYTFGQDISETFNHTNGLSLVSRAHQLVMEGYNWCHERNVVTIFSAPNYCYRCGNQAAIMELDDALKYSFLQFDPAPRRGEPHVTRRTPDYFL

SEQ ID NO: 11018 - protein, 810 aa, Diabrotica virgifera
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGN

SEQ ID NO: 11019 - protein, 540 aa, Diabrotica virgifera
MMQPQILLLKEGTDSSQGKPQLISNINACQNVTDAVRTTLGPRGMDKLIVQRQGHATISNDGATILKLLDIVHPAAKTLVDIAKSQDAEVGDGTTSVVLLAGEFLKQIKPYVDEGVHPRIIIKAVRRSFQICLEKISEIAVKINKSNADEFRSLLEKCAATAMSSKLINQQRSFFSKMVVDAVLLLDDLLPLNMIGIKKVQGGALEESLLVAGVAFKKTFSYAGFEMQPKVYKDCKIALLNIELELKAERDNAEVRVDNVKEYQKIVDAEWTILYNKLQKIYESGANVVLSKLPIGDVATQYFADRDMFCAGRVQEDDMKRTLKACGGAVMTTVNDISDSVLGKCELFEEKQIGGERFNFFKGCPNAKTCTLILRGGAEQFLEETERSLHDAIMIVRRTIKNDAVVAGGGAIEMELSKILRDHSRTIAGKEQLLIGAIAKALEIIPRQLCDNAGFDATNILNKLRQKHAQGHCWYGVDINKEDISDNFEACVWEPAIVKINALTAATEATCLILSVDETIKNQKSEAPPQMGGRGMGRPM

SEQ ID NO: 11020 - protein, 4649 aa, Diabrotica virgifera
MGDSLESTEASHETQNVALVDFTAFSNFILKATTVLLPEDDGQAEPANLVAAIDDKANQECIRKFISDPQIATLYIQRNSSKDDDSVQPPEGEEEKEPVTYYVSNEVHYTNSKMSSLVCIKRGPVIEADKSIRAQVRLMNFSDGSPYEILHDYVSRTVAPFFKSYVKESGRADRDGDKMAPAVEKTIAELEMGLLHLQQNIDIPEITLQVHPYVASLIKQCADEGRKPKVADFSDKVDDSNFLNQLQHGVNRWIKEIQKVTKLDRDPASGTALQEISFWLNLERALHRIQEKRESMEVALTLDILKHGKRFHATVSFDTDTGLKQAIATVNDYNPLMKDFPINDLLAATELERIRAAVQLIFAHLRKVRSTKYPIQRCLRLVEAISRDLGAQLLKVLGTRRLMHIPFDEFEKVMTQCFEVFSIWEDEYEKLQALLRDIMKKKRDEHMKMVWRISPQHKKLQSRMDQMRKFRRQHEQLRTVIVRVLRPSIKGSAVPIEGGDIEPPKPTFSLDAADANAIEEVNLAYENVKEVDCLDISKEGQDAWDAAVQRYEERIDRVETRITAHLRDQLGTAKNANEMFRIFSRFNALFVRPHIRGAIREYQTHLIQRVKDDIEALHEKFKVQYPQSNSAKISKVRDIPPVAGSIMWAKQIDHQLTTYLRRVEDVLGKGWENHIEGQKLKADGDSFRLKLNTQEIFDDWARNVQQRNLGVSGRIFTIEAVRSRSGRGNVLKLKVNFLPEIITLAKEVRNLKCLGFRVPLAIVNKAHQANQLYPFAISLIESVRTYEMTLEKIEDKASIIPLVAGMRKEVQQVIAEGIQLVWESYKLDPYVQRFSDLVVSFQERVEELVLVGEQLEVDVRSLETCPYSANTFADILSKIQHAVDDLSLKQYSNLHIWVSRLDEEVEKNLARRLQAGVEAWTDALSGHKKEIDHSMDTDAPAQPTHKPGGDPQIQTMVHEVRITNQTMYLYPSIEEARFLIMQQLFAWQAIVTSQQRLQSSRYQVGVDKPVTETYRNILTKLPGGAQPLNSAYSAIASKIKEVQNYVNEWLTYQSLWDLQADNLYGKLGEDIGKWMECLNDIKKTRTTFDTSDTRREFGPIIIDFAKVQSKVSLKYDSWHKDTLGKFGGLLSNEMTSFHANVSKSRSDLELQSIEAASTSDAVSFITYVQQLKRSMKAWEKQVDIYKEGQRILERQRFQFPTNWLHVENLEGEWGAFNEIIKRKDSSIQTQVASLQQKIVSEDKAVESRTNDFLNDWEKSKPVEGHLRPDDALSQLQLFESKFSRLKEERDNVAKAKEALELQDPGGISTSEDRMQVVYEELQDLRGVWSELSRIWQQIDETREKPWLSIQPRKLRQQLDALSTQLKELPARLRQYASYEYVKKTLQTYTKVNMLIVELKSDALKERHWKQLMKQLRVNWILSDLTLGQVWDVNLQKNEAIVKDIILVAQGEMALEEFLKQVRESWQNYELDLINYQNKCKLIRGWDDLFNKVKEHINSVAAMKLSPYYKVFEEEALTWEEKLNRINALFDVWIDVQRRWVYLEGIFSGSADIKTLLPVETSRFQSISSEFLGLMKKVSKSPMVMDVLNIPGVQRALERLADLLGKIQKALGEYLERERTSFPRFYFVGDEDLLEIIGNSKNIARLQKHFKKMFAGVASILLNENNTIITGIASREGEEVHFNNPVSTVDHPKINEWLTMVEKEMRVTLASNLTQAVQDIKQFKDGIDSKSYMQWVDKYQAQIVVLAAQILWSEDVEAALVKMNSEPQKGPLEKVLQQVENTLNVLADSVLQEQPQLRRKKLEHLINEFVHKRTVTRRLIANGVCSNKAFEWLCEMRFYFDPRQTEVLKQLTIHMANARFYYGFEYLGVQDRLVQTPLTDRCYLTMTQALEARLGGSPFGPAGTGKTESVKALGNQLGRFVLVFNCDETFDFQAMGRIFVGLCQVGAWGCFDEFNRLEERMLSAVSQQIQTIQEALKSQKEAAAEGVTTGSISVELVGKQVKVSPDMAIFITMNPGYAGRSNLPDNLKKLFRSLAMTTPDRQLIAEVMLFSQGFRQAEKLASKIVPFFRLCDEQLSNQSHYDFGLRALKSVLISAGNVKRDRIQRIKEGMTQRGETNIDEASIAENLPEQEILIQSVCETMVPKLVAEDIPLLFSLLNDVFPNVQYTRAEMKGLKDEIRKVCSEEYLVCGEGDERGSAWMEKVLQLYQISNLNHGLMMVGPSGSGKSSAWRVLLKALERFEGVEGVAHVIDPKAISKEALYGVLDPNTREWTDGLFTHILRKIIDNVRGEINKRQWIIFDGDVDPEWVENLNSVLDDNKLLTLPNGERLSLPPNVRVMFEVQDLKYATLATVSRCGMVWFSEDVLSTDMIFENYILRLRNIPLEESEDSGFGKKNDKDDMLSPTLQLQVDVVNLLQPYLSPDGLVVRCLEYAMEQEHIMDFTRLRALSSLFSMLNQAVRNVLQYNHMHPDFPLTNDVLDKYIPKCLIYSILWSFAGDAKLKIRSDLGDFIRSVTTVPLPPDNNMPIIDYEVTIEGEWSLWSNKVPQIEIETHKVASPDVVVPTLDTVRHESLLYTWLAEHKPLVLCGPPGSGKTMTLFSALRALPDMEVVGLNFSSATTPELLLKTFDHYCEYRKTPNGVVLSPIQLGKWLVLFCDEINLPDMDNYGTQRVIMFLRQIVEQKGFYRASDQSWVSLERIQFVGACNPPTDPGRKPLSHRFLRHVPVIYVDYPGETSLKQIYGTFTRAMLRLAPGLKGYAEPLTNAMVEFYLASQDRFTQDMQPHYVYSPREMTRWVRGICEAIRPLDNLAVEGLVRLWAHEALRLFQDRLVEDTERRWTNENIDAVALKHFPSANCEKALERPILYSNWLSKDYVPVGREQLREYVKARLKVFYEEELDVPLVLFDEVLDHVLRIDRIFRQPQGHLLLIGVSGAGKTTLSRFVAWMNGLSIFQIKVHNKYTAEDFDEDLRSVLRRSGCKHEKIAFILDESNMLDSSFLERMNTLLANGEVPGLFEGDEYTTLMTQCKEGAQREGLMLDSNDELYKWFTQQVMRNLHVVFTMNPSTDGLKDRAATSPALFNRCVLNWFGDWSDGALFQVGKEFTNRLDLEKQSWRCPDFFPAACHHISASPTHREAVINACVYVHQTLHKANSRLVKRGSRTMAITPRHYLDFIHHLVKLYNEKRSDLEEQQLHLNVGLNKIAETVEQVEEMQKSLAVKSQELQAKNEAANAKLRQMVKDQQEAEKKKVQSQEIQQQLAEQTIHIEQKRSEVMADLEQVDPAVIEAQLAVKSIKKQQLVEIRTMANPPALVKLALESICLLLGENASDWKSIRAVIMRDNFINTVVNNFNTEDISDDVREKMKNRYLSNPDYNIDKIYHASNACGPLVKWACAQVQYADMLKKVEPLREELKSLEQQAETNQKRGEDVKALISQLEQSIAAYKEEYAQLIAQAQAIKTDLENVQAKVDRSIALLKSLVIERERWEASSETFRSQMSTIIGDVLLSAAFIAYGGYFDQHYRQNLFSTWCQHLTQASIQYRADIARTEYLSNPDERLRWQANALPTDDLCTENAIMLKRFNRYPLIIDPSGQATEFIMNEFKDKKITKTSFLDDSFRKNLESALRFGNPLLVQDVENYDAILNPVLNRELRRTGGRVLITLGDQDIDLSPSFVIFLSTRDPTVEFPPDICSRVTFVNFTVTRSSLQSQCLNQVLKAERPDIDAKRSDLLKLQGEFHLRLRQLEKSLLQALNDAKGKILDDDSVITTLETLKQEAAEIGQKVEETDKVISEIETVSQQYLPLSQACSNTYFTMDSLNQVHFLYQYSLKMFLDVFATVLHNNSQLDGISDYQARLNLITSNLFSVVYERVARGMLHNDRLTFAILLCRIHLKGQLTEPNLDQEFNFFLRGKEGVFSNTGAFATDGLNSDQQEAVVRLSTKLPTFKKLANQIKEMPEFGAWLQQGSPEQAVPQLWIEEKQLSAVGRAMYQLLVIQAFRPDRVIAAAHNFVSVVLGADFMYLAEKELEFAACVEKEIRSNVPALLCSVPGFDASGRVDDLAAELNKQISSIAIGSAEGFNQADRAINMACKTGRWVMLKNVHLAPQWLVQLEKKLHSLQPHANFRLFLTMEINPKLPVNLLRAGRIFVFEPPPGIRANLLRTFSTVPASRMMKAPNERARLYFLLAWFHAIVQERLRYCPLGWAKHYEFSESDLRVACDTLDTWIDTTAMGRTNLPPEKVPWDALVTLLSQSIYGGKIDNDFDQRLLHSFLNKLFTPKSFESDFALVANIDNGPGGNRHITMPDGTRRDHFLKWIESFADRQTPAWLGLPNNAEKVLLTTRGTDLIAKLLKMQQLEDDDELAYSIDDSSPTDHAEIDGRPSWMKTLHNSAHTWVNLLPTSLQTLRRTVENIKDPLYRYFEREVNSASKLLIDVLHDLNDVLLICQGDKKQTNYHRLMLAELVRGIIPKNWHRYTIPKGCTVMQWITDFSQRVKQLQKVSQVVSSSGAKELQSLPVWLGGLLNPEAYITATRQCVAQANSWPLEELHLDVTITDSTDKDSIPHDCFAVIGIKLQGAQCRNSQLLLTSSIMIELPITLFRWVRMATGDEKLKEGKLSLPLYLNSTRTELLYTVELNIAAGQDPHSFYERGVALLTSTSLN

SEQ ID NO: 11021 - protein, 890 aa, Diabrotica virgifera
MDRPSTSKRNVFDSDSDSVDSTEEARRRDLKERDEFANRLKKRDEERTRNVASTSDKRAYEEAAKRLKLDNAEKEKLIPALRVASRRKYLEKRKEDKLQELEADIADDEYLFEEDVLTEREKKDRVHKKELLKLAQEHEKARELERVQRYHMPRDLGKDSTADYIEVDDLEKVPQSEQKKWEKDQMASAVFKFGAKDGIKKEEYELVLEDQIQFIQALQMPGVSDKKEPELTETEKKKLTIEETKKSLPIYPFKDDLIQAIREHQVLIIEGETGSGKTTQIPQYLYEAGFCEDGKKIGCTQPRRVAAMSVAARVAQEMSVKLGNEVGYAIRFEDCTSERTVIKYMTDGTLHREFLSEPDLASYSVMIIDEAHERTLHTDILFGLVKDIARFRPDLKLLISSATLDVTKFSDFFDDAPVYQIPGRRFPVDIYYTKAPEADYVDACVVSVLQIHVTQPLGDILVFLTGQDEIETCQELLQDKVRRLGSKVKELLILPLYANLPSDMQGKIFEPTPPGARKVVLATNIAETSLTIDNIIYVIDPGFAKQNHFNSRTGMESLMVVPISKASANQRAGRAGRVAAGKCFRLYTAWSYKHELEDNTIPEIQRINLGNAVLMLKALGINDLVHFDFLDPPPHETLVLALEQLYALGALNHHGELTKLGRRMAELPVDPMMAKMILASEKYKCSEEIVTIGAMLSVNGAIFYRPKDKIIHADTARKNFSHLAGDHLSLLNVYNQWRDSDYSLQWCYENFIQYRSMKRARDVREQLVNLMTRVEIEIVSNVSETVDIRKAITSGYFYHIARFSKGGSYKTVKHNQSVTIHPNSALFESLPRWVLYHELVFTSKEFMRQVIEIESKWLLEVAPHYYKQKELEDPTNKKMPKTVGRSTRTD

SEQ ID NO: 11022 - protein, 456 aa, Diabrotica virgifera
MKVEEVKSTVKTQRISAHSHIKGLGLDEAGFAIPSAAGLVGQEQAREAAGIVVDMIKSKKMAGRAVLLAGPPGTGKTAIALAIAQELGNKVPFCPMVGSEVYSSEIKKTEVLMENFRRAIGLRIRETKEVYEGEVSELTPVETENPAGGYGKTVSHVIIGLRTAKGSKQLKLDPGIYEALQKEKVEVGDVIYIEATSGAVKRQGRSDAYATEFDLEAEEYVPLPKGDVHKKKEVIQDVTLHDLDAANAKPQGGQDVLSMMGQLLKPKKTEITDKLRKEINKIVDKYIDQGIAELVPGVLFIDEVHMLDIETFTYLHRALESAIAPIVIFATNRGRCLIRGTDDVYAPHGIPLDLLDRLLIIRTIPYGRSDMEQILKLRATTEGLEIDHEAIASLGEVGAKATLRYAVQLLTPAHLTAKINGRNNILQSDIEEVGSLFLDAKASAKVLSENKEKFMT

SEQ ID NO: 11023 - protein, 732 aa, Diabrotica virgifera
MTSIIKLQALSGAKDESPPCYILQIDEVRILLDCGWDEKFDMEFIKEIKRHVHTIDAVLLSYPDIYHLGALPYVVGKLGLNCPIYATIPVYKMGQMFMYDLYQSQYNMKEFCIFSLDDVDTTFEKIIQLKYNQNVPLKGKGYGLTITPLPAGHMIGGTIWKIMKMEEDIIYCNDFNHKKERHLNGCELDRLQKPSLLITDAFNATYQQARRRARDEKLMTNILQTLRNNGNVLIAVDTAGRVLELAHMLDQLWRNKESGLLAYSLAFLNNVSYNVIEFAKSQIEWMSDKLMRSFEGARNNPFQFKHLQWCHSLAELSKVPSPKVVLASSPDLESGFSRELFLQWCSNSNNSIILTTRTSPGTLARDLIDNGAERNIDLTVERRVKLEGVELEEYEKRQRARGQNVEKEDADSDSDSDIEMSVITKGRHDIVIKQEGKINAGFFKVTKKMYPMYPFHEEKIKSDEYGEIIKPENYKLADVAVEGEDNKENVLIKKEVEEEITEIHEQPTKCIVLQRTVQVNCQVHYIDFEGRSDGESLMKILSQLKPRRVIVVRGDEENTSVIAKHCEGIKARVFTPSRGEIVDATSETHIYQVRLTDALVSQLSFQKAKEAEVAWITANVVLKESQADAKRVYVDDEPMEVEDVDTRILTLEPVLEGDCHDPVFINELKLSEFKQVLGRHNITSEFSGGVLWCSNGTIAVRRVESGKIMLEGCISEDYYRVKDLLYEQYAIL

SEQ ID NO: 11024 - protein, 760 aa, Diabrotica virgifera
MAPLESTNNNNNEEPGPINPIVGIIYPPPEVRNIVDKTASFVARNGPEFEARIRQNELGNPKFNFLNSGDPYHSYYQHKVKDFREGKGQDPTPGLTQAVSKLSVTASAQQKQQEILKQVEQPFIPKETPSEFEFIADPPSISALDLDIVKLTAQFVARNGRAFLTQLMNREQRNLQFDFLRPQHSLFQYFTKLLEQYTKVLIPPKSMHESLRNEANSPKNVLEQVKYRAEWLKYQEQQKAKEEELLERERVAYAQIDWHEFVVVETVDYQPFEIGNFPAPTTPEEVGARILIQERIEEGEDIEMQLESDEEEPPVMEAGLSSMQDKTNRKTRDDTRIQDMEEESSDEEKEEEEELALPPPPPSIQPPLPPIPDKVVVKKYDPKQAVNVSRPTIGDDFLVSPITGEKIPANKVQEHMRIGLLDPRWVEQRDKQITDKMNQETVYAAGSAIDASLKLLAERRTDIFGVGDEETAIGKKIGEEDVRKDEKVTWDGHTSSVEAATRAARANITLEEQIHQIHKVKGLLPDEEKEKIGPKNIGSKSGKINIQSVITTKPPTSLQPKPPVSLIQTQATASLISVPPQPMLPPQPPIMMMSATSMPPIRPPPIMMTGPPPIPGFPVAPMSSPMGPPMNLSPMKHQAEAPHEDEPSNKKMRNEDSLIPEKLFLARHQSQVAIKISIPHMPEKSEWKLTGKMISWTVPLAESVANLKAKLQEETNMPPAKQKLFFDGMFFKDSNSLAYYNVTTGSIIQLQIKERGGRKK

SEQ ID NO: 11025 - protein, 322 aa, Diabrotica virgifera
MPSQELTTNKVIVHPLVLLSVVDHFNRMGKIGNQKRVVGVLLGCWRAKGVLDVSNSFAVPFDEDDKDKSVWFLDHDYLENMYGMFKKVNARERVVGWYHTGPKLHQNDIAINELIRRYCPNSVLVIIDAKPKDLGLPTEAYQAVEEVHDDGSPTSKTFEHVPSEIGAEEAEEVGVEHLLRDIKDTTVGTLSQRITNQLLGLKGLHSQLRDIRDYLVQVCGNQLPINHQIIYQLQDIFNLLPDINQDAFNTSFYVKNNDQMLVVYLAALVRSIVALHNLINNKLTNRDAEEGKKEDSKKESKDKDKDKEKEKDKDAKKDEKKK

SEQ ID NO: 11026 - protein, 551 aa, Diabrotica virgifera
MFGGGRAPILVLSQNTKRESGRKVQLENINAGKQIADVIRTCLGPQAMLKMLMDPMGGIVMTNDGNAILREITVQHPAAKSMIEIARTQDEEVGDGTTSVIVLAGEMLVAAEQFLEQHIHPTIIIRQYRQALEDMIQLLEGPLSIPVDRNDKNALAQVVKGCIGTKFISKWSDLAVNIALDAVNTVLLEENGRTEVDIKRYAKVEKIPGGSIEESKILRGVMLNKDVTHPKMKRYIQNPRIILLDCALEYKKGESQTNVEISAETDFTKLLELEEEHVKRQCDEIIALKPDVVFTEKGVSDLAQHFLLKAGITAIRRVRKSDNNRIARACGATIVNRTEELQESDVGLGAGLFEIKKIGDEYFCFVVECKNPKACTILLRGASKDILNETERNLQDALQVARNIVLSPRLVPGGGAIEMAVAQRLMQKATHGPYRALAHALEIIPKTLTQNCGANTIRTLTALRAKHANHTDVNKPCLWGIDGETGELVEMDKKELWEPLAVKLQTYKTAIETAILLLRIDDIVSGSKKKGGNEPPTPSQMQQQEARGEAE

SEQ ID NO: 11027 - protein, 233 aa, Diabrotica virgifera
MMQTANNAYYPDYSTAPMQRQINPYADNGGSVVAIAGEDFVIIGADTRLSTGFSIYTREQNKLFPLSGTTVLGCAGCWCDTLTLTRILKSRMQMYQQEHNKTMSTTACAQMLSTMLYYKRFFPYYISNILVGLDNEGKGCVYSYDPIGHCEKATYRAGGSAGALLQPLLDNQIGQKNMLKTSGEPLSQEKALSTLKDVFISAAERDIYTGDSVLINIITKDGVKEESFQLRRD

SEQ ID NO: 11028 - protein, 298 aa, Diabrotica virgifera
MFQFGFNMFPEVPRPFNMTYKCYSVAMFPGNEREDVERGGKIIMPPSALEQLTRLNINYPMLFKLVNKKTHRTTHCGVLEFVADEGKVYLPLWMMNNLVLTEGDLVQMESVSLPVGTFSKFQPLNPDFLDITNPKAVLENGLRSFACLTTGDVIAVKYNQKAYELCVLETKPGDAISIIECDMNVEFAAPVGYKEPEQVKKEEEEMAIDPADLMPEPSGFVAFRGAGNRLDGKKRKDTSGTDSSVAKPTYVRGIPDYDYQIGNLKFIRRMIKQKSNDYAEDSEFKAFSGAGFSLKSRT

SEQ ID NO: 11029 - protein, 540 aa, Diabrotica virgifera
MSAIPGSIAFDEYGRPFIILRDQDKQKRLTGIDALKSHILAARQIAQTISTSLGPKGLDKMMVSPDGEVTVTNDGATILKMMDVEHEVAKLLVQLSQSQDDEIGDGTTGVVVLAGALLEQAGSLLDRGIHPIRIADGFELACQTAVAHLEKIAELFPVSAENTEPLIKVAMTTLGSKIINKCHKQMAEIAVNAVLAVADLEQKDVNFELIKVEGKVGGKLEDTTLVKGVVIDKTMSHPQMPKELKDVKLAILTCPFEPPKPKTKHKLDVSSVEDYKELRQYEQEKFKEIVGLVKKAGATLAICQWGFDDEANHLLLQQELPAVRWVGGPEIELIAIATGGRIVPRFEELTPEKLGHAGLVREIAFGTTKDRMLVIEECSNSRAVTILVRGGNQMLVAEAKRSLHDALCVVRSLVQEPRVVYGGGAAEIACCLAVAAQADQLASLEQYAYRAFAEALESIPLALADNSGLSAIHTLGEVKAKQAATGDPALGIDCMNTGNLNMREQHVIESLRSKRQQFLLATQLVKMILKIDDVRQPASG

SEQ ID NO: 11030 - protein, 113 aa, Diabrotica virgifera
MASAMDVDAEEVELPTSSSSKGEKKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 11031 - protein, 534 aa, Diabrotica virgifera
MVSLNPVRILKQEAEEERAEIARLSSFVGAIAIGDLVRSTLGPKGMDKILVSSGRSAGSVEVTNDGATILKSVGVDNPAAKILVDMSKVQDDEVGDGTTSVTVLASELLKEAEKLVEQKIHPQTIIAGWRKAVDIARKALLETAKDNSSDSEKFREDLMNIARTTLSSKILSQHKEYFAKLAVDAVLRLKGTGDLQSIQLIKKTGGTLEDSFLDEGFLLDKKPGVHQPKRVENAKILIANTPMDTDKIKVFGSHIKVDSMAKIAELESAEKEKMKDKVNKILKHNANVFINRQLIYNYPEQLFADAGVMAIEHADFDGIERLALVTGGEIVSTFDHPELVKLGTCKLIEQIMIGEDILLRFSGVALGEACTIVIRGATQQIIDEADRSLHDALCVLAATVKESRIVYGGGCSETLMSTAVSRAAANTPGKEAVAMEAFARALLQLPTIIADNAGYDSAQLVSELKAAHNSGQSTMGLNMEKGELGDMKTLGITESFVVKRQVLVSASEAAEMILRVDNIIKAAPRRRTEDRGMC

SEQ ID NO: 11032 - protein, 283 aa, Diabrotica virgifera
MFRNQYDSDVTVWSPQGRLHQVEYAMEAVNLGSATVGLKSKTHAVLIALKRASSELSAYQKKIINIDDHIGITISGLTADARILSRYMRNECLNYKYSLDTYMPLNRLISILGNKMQTCTQRYDRRPFGVGLLVAGYDESGSHIYQTCPSANFYDCKAMSIGARSQSARTYLEKHLDELPSSSLEELIKHGLRALRDTLPPEVDLTTKNVSIGYTGKGQTFKILEEEETSPYLSLIEGEERRGGGAAAAAIEDLPADPLRDDAGDEPRDAVPAVETSAMDTTE

SEQ ID NO: 11033 - protein, 848 aa, Diabrotica virgifera
MPIKPGDETENMEITFSDEDLPYEEEILRNPYSVKHWLRYIDHKKTAPNNGVNIIFERALKELPGSYKLWYNYLRTRRNQIKSKCITDPGYEEVNNAFERSLVFMHKMPRIWMDYCTFLTDQCKITRSRKVFDRALRALPVTQHNRIWPLYLKFVQKHDIPETAVRVFRRYMKLCPENAEEFIDYLTGIERLDEAAQLMAKIVNDEGFVSQQGKSKHQLWNELCELISKNPEKVHSLNVDAIIRGGLRRYTDQLGHLWNSLANYYVRSGLFERARDIYEEAIQTVTTVRDFTQVFDAYAQFEELSLSKRMEEVANKSSPTEDDDTELELRLGRYAYLMERRLLLLNSVLLRQNPHNVQEWHKRVQLYEGKPVDIINTYTEAVQTVDPKLAVGKLHTLWVDFAKFYETNGQIEDSRLIFEKASQVSYVKVDDLATVWCEWAEMEIRNENYDEALRLMHKATVMPSRKVAYHDDTETVQSRLYKSLKVWSMYADLEESFGTFKSCKAIYDKIIDLKIATPQIIINYGIFLEENNYFEEAFRAYEKGISLFKWPNVYDIWNTYLTKFLTRYGGSKLERARDLFEQCLDGCPQQFAKHLYLLYAKLEEEHGMARHAMAVYERSTKAVPEQEMFDVFNIYIKRAAEIYGIPKTRQIYEKAIEVLPEDKTREMCLRFSDMETKLGEIDRARAIYAHCSQICDPRITAEFWQIWKEFEVRHGNEDTMREMLRIKRSVQAVYNTQVNMMSAQMLSSAGSMSGTVADLAPGVKDGMRLLEAKAVEMAGTSQVAKPGGIMFVRGETQGANKDKVVNPDEIDIDSEESEAEEEVPVEKQNVPSEVFGSLKKQGQGDDDD

SEQ ID NO: 11034 - protein, 391 aa, Diabrotica virgifera
MANGPIAERNRDATIYVGGLDDKVSESLLWELFVQAGPLVNVHMPKDRVTTMHQGYGFVEFMGEEDADYAIKIMNMIKLYGKPIRVNKASAHQKNLDVGANIFIGNLDPEVDEKLLYDTFSAFGVILQTPKIMRDPDTGNSKGFAFINFASFEASDASIEAMNGQYLCNRPISVSYAFKKDSKGERHGSAAERLLAAQNPLSQADRPHQLFADAPPIGLMPMSMAPPPPPVIMTGMMPPPPPTLSNLPPPPPPVPPPGMGSSFPAGIPPPPLPPSQPPLPPGAPPTMPTAAGAQARPPLPPPPVAPHGLIPPPPTWTGAAPGSLPIPPGPPTPAGGASFGGMFPPPPPPGGRPPPPNWRPPPPPPPGFAGGRPAFPVRGPPPPPPTFDTKI

SEQ ID NO: 11035 - protein, 257 aa, Diabrotica virgifera
MGRVIRAQRKGAGSVFKSHTKKRKGAPKLRYLDFSERHGYIKGVVKDIIHDPGRGAPLAVVHFRDPYKFQTRKELFIAPEGMYTGQFLYCGKKANLQIGNVLPVGTMPEGTIVCNLEEKTGDRGRLARASGNYATVIAHNHDTKKTRVKLPSGAKKVIPSNNRAMVGIVAGGGRIDKPILKAGRAYHKYKVKRNCWPKVRGVAMNPVEHPHGGGNHQHIGKASTVKRGTSAGRKVGLIAARRTGRIRGGKVDAKKED

SEQ ID NO: 11036 - protein, 138 aa, Diabrotica virgifera
GIMARTKQTARKSTGGKAPRKQLATKAARKSAPATGGVKKPHRYRPGTVALREIRRYQKSTELLIRKLPFQRLVREIAQDFKTDLRFQSSAVMALQEASEAYLVGLFEDTNLCAIHAKRVTIMPKDIQLARRIRGERA

SEQ ID NO: 11037 - protein, 530 aa, Diabrotica virgifera
MAISLLNPKAEVARAAQALAVNISAAKGIQDVMKSNLGPKGTVKMLVSGAGDIKITKDGNVLLHEMQIQHPTASLIARASTAQDDMTGDGTTSTVLVIGELLKQADIYIAEGLHPRLLTDGFDKARTKALEVLEKMKISIEANKETLTDICRTSLRTKLHQKLADVLTDVCVDAVLAIKKDDKPVDLHMVELMEMQHKTETDTQLIKGLVLDHGSRHPDMPKSLNNCYILTCNVSMEYEKSEVNSGFFYKTAEEREKLVTAEREFIEQRVKKVIELKRSLCNGTDKTFVVINQKGIDPMSLDMLAKEGIIALRRAKRRNMERLSLACGGVAMNSFDDLQESQLGRAGHVYEHVLGENKYTFVEDCKIPQSVTILMKGPNKHTLTQIKDAVRDGLRAINNAIDDKAVIPGAGAFEVTANKELLAFKDTVKGKARLGVAAYAEALLVVPKTLAVNSGFDAQDTILKLQEESRLNPDPIGLDLTSGEPINPKDAGIYDNYIVKKQIINSCSVIASNLLLVDEIMRAGMSSLKG

SEQ ID NO: 11038 - protein, 1039 aa, Diabrotica virgifera
MSSGSLADNSIDPPAKKRKLESKIATLEMANNEASGSSTSDIDEGLYSRQLYVLGHEAMRRMANSDVLISGLGGLGVEVAKNVILGGVKSVTLHDEALCTIKDLSSQFYLTEGDIGKNRAEACCKQLSELNTYVPTKSYTGPLDEAFILKFSAVVLTTSNREEQLRISEITHENNIALIIADTKGLFAQVFCDFGKSFTVVDVNGEPLVSAMIADISNDVESVVTCIDDTRHGMEDGDYVTFSEVQGMTELNNCEPIKIKVLGPYTFSIGDTTKFSKYTRGGIVSQVKMPKHLEFKSFKDSLENPEIPITDYSKMDFPTQLHLAFTTLHKFVEKSARLPKPWNNEDATEFVNLAKSLAAKGDSEGEVNVDLLDTFAKVSAGDLNPINATIGGIVAQEVMKACSGKFHPIFQWFYYDAIECLPQDKSEITEELAAPTGSRYDGQVAVFGKEFQKKLASLKYFIVGAGAIGCELLKNFAMMGVGTQGEVTVTDMDLIEKSNLNRQFLFRPHNVQQPKSATAAKVIKKMNPDINVVAHENRVGPETESVYNDDFFEKLDGVANALDNVDARIYMDRRCVYYRKPLLESGTLGTKGNTQVVAPFLSESYSSSQDPPEKSIPICTLKNFPNAIEHTLQWARDMFEGLFKQNAENASLYITDPDFLDRTVKLPGVQPLEVLESVKAALIDERPKDLNDCIAWARNHWQEQYSNQIRQLLFNFPPDQLTSTGQLFWSGPKRCPEALTFDVNDPLHLDYVIAAANLKAEVYGIPTSRNREQIAEVVMQVNVPEFIPKSGVKIAVTDSQMAMNGNNVDLDRVSQIKEELPSVAELGGLRLTPLEFEKDDDTNFHMDFIVAASNLRAANYKIPPADRHKSKLIAGKIIPAIATTTSVVAGMVCLELYKLTRSYTSLTPFKNNFINLALPFFSCSEPIAAQQMEYCGNKWTLWDRFDVQGEMTLSEFLEYFKEKHGLEITMLSQGVCMLYSFFMAKAKAQERFGLSMSEVVRRVSKKKIEPHVKALVFELCCNDSTGEDVEVPYVKYNLC

SEQ ID NO: 11039 - protein, 262 aa, Diabrotica virgifera
MADADDLLDYEDEEQTEQTATETATTEVQKKGVKGTYVSIHSSGFRDFLLKPAILRAIVDCGFEHPSEVQHECIPQAVIGMDILCQAKSGMGKTAVFVLATLQVIDPTENVVYVLVMCHTRELAFQISKEYERFSKYMPNIKVGVFFGGLPIQKDEETLKNNCPHIVVGTPGRILALVRSKKLNLKHLKHFILDECDKMLELLDMRRDVQEIYRNTPHEKQVMMFSATLSKEIRPVCKKFMQDVIQNSYNTQFCNDAPTRNV

SEQ ID NO: 11040 - protein, 489 aa, Diabrotica virgifera
MVTLEDVEMKNADSPPGLEAGDTKKDTDLQSVIEIREHARQIEKSVTSKENRFILRVLRCLPNTRRKLNGLVLRSLITQIYPVAERDALLSFVEEASGELDATQSRARSAVKSPVPEVDTYINLLILVRLIDTNKLVEAERCSQALMNKITNQNRRTIDHIAAKCYFYHSRVAELTNKLDSIRGFLHSRLRTATLRNDFEGQAVLINCLLRNYLHYSLYDQADKLVSKCVFPETASNNEWARFLYYLGRIKAARLEYSVAHKHLVQAMRKAPQNAAIGFRQVVQKLTVVVELLLGDIPERQIFRQSSMRHSLAPYFQLTQAVRMGNLQRFGEVLENFGPQFRQDHTFTLILRLRHNVIKTAIRSIGLSYSRISPQDIAKKLGLDSAEDAEFIVAKAIRDGVIEATLDPQGGYMRSKESTDIYCTKEPQLAFHQRISFCLDLHNQSVKAMRYPPKAYGKELESAEERREREQQDLELAKEMAEEDDDGFP

SEQ ID NO: 11041 - protein, 555 aa, Diabrotica virgifera
MATNHQNLPISSILKSKSEVDDEPKKKSREDWRKAKELEEARKAGTAPAAVDEEGKDINPHIPQYISNAPWYYGTSGPTLKHQRPQEEKQKEYSNIDEWYKRGVDTSKIVTKYRKGACENCGAMTHKKKDCMERPRKVGAKFSGANIAPDEFAQKNLALSFDGKRDRWSGYDPSEHKAVIEEFQKVEEAKRQLKADKLNANESSDDEEKDEDKYVDEVDMPGTKVDSKQRITVRNLRIREDTAKYLRNLDLGSAYYDPKTRSMRENPNPEKDATYSGENFVRFTGDTTNHAKAQLFAWEAYEKGVDVHLLAEPTKLELLKKEYEKKKEQVKSTIQGSVLDKYGGQEHLEAPPKSLLLAQSEVYVEYSRSGRVITGAEKEVIRSKYEEDVYINNHTSVWGSYWRGGQWGYKCCHSFIKNSYCLGEAGKTVNAPVTQDIPKDQDVGEASSTKEAGISDGESEDSSSSNSSEGEKLKKKQRRLKKKEKKAKKKEKKAKEKLKKKQEKEKAPEIDEEIMLDDRKRPYNSMFDAKKPTEEEMEEYYKKRKRDEDPMNNFM

SEQ ID NO: 11042 - protein, 208 aa, Diabrotica virgifera
MGISRDHWHKRRSTGGKRKPLRKKRKFELGRPAANTKLGARRIHYVRTRGGNLKYRALRIEKGNFAWGSEGTARKTRIIDVVYNASNNELVRTKTLVKNAIVVIDATPFRQWYESHYILPLGRKKGAKLTAEDEEMFNKKRSKKVQKKYETRQKTAKVEPALEEQFSTGRLLACLASRPGQCGRADGYVLEGKELEFYIRKIKSKKAK

SEQ ID NO: 11043 - protein, 311 aa, Diabrotica virgifera
MDRLLRLGGGMPGLTQAPPPSDAPVVDTAEQVYISSLALLKMLKHGRAGVPMEVMGLMLGEFVDDYTVRVIDVFAMPQTGTGVSVEAVDPVFQAKMLDMLRQTGRPEMVVGWYHSHPGFGCWLSGVDINTQQSFEALSERAVAVVVDPIQSVKGKVVIDAFRLINPNMMVLGQEPRQTTSNLGHLQKPSVQALIHGLNRHYYSISINYRKNELEQKMLLNLHKKSWMDGLTLADYSENCSVNEKTVADMLELAKNYNKALEEEEKMTPEQLAIKNVGKQDPKRHLEEKVDILMTNNIVQCLGAMLDTVVFK

SEQ ID NO: 11044 - protein, 404 aa, Diabrotica virgifera
MTVINKMEVDGGPKGEGFRSYYITKIEELQLIVAEKSQNLRRLQAQRNELNAKVRMLREELMLLQEQGSYVGEVVKPMDKKKVLVKVHPEGKFVVDIDKNIDINDVTPNCRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 11045 - protein, 199 aa, Diabrotica virgifera
MVKIYCLSVLYKGPTTATWLKSAFELQSFSFFQRGSIQEFMSFFCKTIVERTIPASRQSVKEGEYLCHVYVRADNLAGVIITDHEYPSRVSHTLITKILDEFGAKIPAANWPSLEERDVPFPQLNTYLAKYQNPREADAITKIQEDLDETKIILHNTIQAVLERGEKLDDLVSKSEGLSIQSKAFYKTARKTNSCCSFT

SEQ ID NO: 11046 - protein, 242 aa, Diabrotica virgifera
MFLTRSEYDRGVNTFSPEGRLFQVEYAIEAIKLGSTAIGICTSGGVVLAVEKRITSPLMEPTTIEKIVEVDKHIGCAVSGLMADSRTMIDRARVECQNHWFVYNENISVESCAQGVSNLAIQFGDSDEDGAAMSRPFGVAILFAGIDEKGPQLYHMDPSGTFVQFDAKAIGSGSEGAQQSLQEAYHRSMTLEEATTTALTILKQVMEEKLNSSNVEVMTMTPKDMFHMFTKEQVEEVIAKLS

SEQ ID NO: 11047 - protein, 557 aa, Diabrotica virgifera
MSILASPLSVAGSRTTGASVRTQNVMAASTIANVVKSSLGPVGLDKMLVDDIGDVTVTNDGATILRLLEVEHPAARVLVELAQLQDEEVGDGTTSVVIIAAELLKNADELVKQKIHPTSIISGYRLACKEACRYIQDHLTIPVEELGKECIINVAKTSMSSKIIGADADLFSQIVVDAANAVKVTDSRGNSMYPIKAVNVLKAHGKSARESFLVPGYALNCTVASQAMPKKIVNAKIACLDFSLQKAKMKMGVQVLITDPNQLEAIRTRELDITKERIQKILSTGVNVILASGGIDDLCLKYFVENGAMGVRRVKKADLKRIAKATGATFLTSLSNMEGDESFDSSMVGEAAEVVQERISDDELIIIKGPKARTAASIILRGPNDFYCDEMERSVHDALSVVKRVLESKSVVVGGGSVEAALSIYLENFATTLSSREQLAIAEFARSLLVIPKTLAVNAAQDATDLVAKLRAYQNSSQTKKDHAHLKYVGLDLMEGTVRDNRKAGVLEPTMSKIKSLKFATEAAITILRIDDMIKLDSEQRGGKSYQQAMESGELYD

SEQ ID NO: 11048 - protein, 251 aa, Diabrotica virgifera
MFNSAAPPLWHNGPVPGEFYNFPGKQTSYSNPITHTQSPVTTSTSVLAITYDKGVLIAGDLVASYGSLARYRNCPRVIKVNQNIILGAGGDYADFQYVKSFIEQKIIDEECIDDGLKMKPKSLYCWLTRVMYQRRSKLDPFWNNLVIGGIQDGVPFLGTVDKLGTAYTDKVICTGYGAHIALPLLRDSLDKNGALNLADAKTLIHKCMEVLFYRDARSFPKYQLGVIDKDDGVSIEGPISVEENWSIAHMT

SEQ ID NO: 11049 - protein, 703 aa, Diabrotica virgifera
FKNMEFSKEPNFQLLSARDFTPEKYVKNLSQSYVGGSELQNLRRKLQSLSEETSNNLKKNVYENYVQFIETAKEISHLESEMYQLSHLLSEQKSLLSALSTTSILEDTQHLNIERENKSNDKDIEEENKQKLAAILEKVEGCKELLEVPGRKFLYEGDLLEIDPTENTSLKTVHVYLFTDGFMITNRNSNSRGLMKYIYEIMYDLSSLAVVNVRDLGNVKHAFKLLIFPDTRVFQCSSNSNKKEWLDKFDQAKKTRLAQEQHKRESISEKSPSRSASIESPSYNPFDEVEDDVGTVQPEWFLDIPEELDVCVAQRHFEEALSLLQKAKEYISQMTAGNEKHDHVFLDIQRKVEQRQNSLTEVLMKELEVNPDKSLQGGLRAARRAVRLLNQLGRENQSCNLFLKLCSSMLRTQCKRVKREGSTTTYIRNLASVVFTNMCHMSDEFLRAFPDSPTCASAYVVWASNELLLFTGHFIKQVFMPQTSLSTVTECIVLVRTQCERLYSYGLDLCYQLDGALRSSLVKALKDARDKLIDSIKLRALEDKWIPINLHSKSALGRFLHEHSQMGLNLESYVSGDTWIQLTASTLSFTKMFFQLLNDCMKLKTTELVYTIDETLYNVFDAQLKHNENALRNELNQDQRSFLTKNAEFLLVNVVEVSQKIYSQNVGYECATLKKLQGEYVALKKGVSPTTRSTKTKYSSEFL

SEQ ID NO: 11050 - protein, 1238 aa, Diabrotica virgifera
MDELQKLEYLSLVSKVCTELENHLGMNDKDLAEFIIHLSEKNGTFESFKKALIENGAEFSDSFISNLLRIIQHMKPKKNKSKVEADVYQKETLATKFPGLALPNEKQKPLFIDEEAPAEKNEDDDIVADLMKQFEADAPSNSQIQTTTKSGSASPIERKRSSRSRSRSKPRKRRKSRSRDRDSRKDKRRSRSRDQKKNRRDRSGSRNKRNKERSRSRNRRSRSRDRRSRSRDRRNRSKDRKYKNYSRDKDRRERSNSRDIKRDRSTEKKFKSEKDNPEFEDDPTPGKIYNGKVSNIVPFGCFVQLEGLKRRWEGLVHISQLRAEGRVTNVSEVTSRGARVKVKVLTVTGQKVSLSMKDVCQITGKDLNPHSHAPTEREDRDRNPDRPVNSSTSVLRLPVNIDEGEEDSRKRVTRISSPERWEIKQMISSGCIAKSELPDFDEETGLLPKDEDGEADIEIELVEDEAPFLQGHGRALHDLSPVRIVKNPDGSLAQAAMMQSALAKERREQKMIQREQEVDSQPSGKNKSWIDPLPEDESRMMGRGIGLQVQDLPEWKKHVIGGKKSSFGKKTNLTIIEQRQSLPIYKLKEELRKAVTDNQILIVIGETGSGKTTQITQYLAEAGFTSRGKIGCTQPRRVAAMSVAKRVAEEFGCRLGQEVGYTIRFEDCTSPETMIKYMTDGMLLRECLMDLDLKQYSVIMLDEAHERTIHTDVLFGLLKQAVMKREELKLIVTSATLDAVKFSQYFFKAPIFTIPGRTFPVEVLYTKEPETDYLDASLITVMQIHLREPPGDILLFLTGQEEIDTACEILYERMKSLGPDVPELIILPVYSALPSEMQTRIFEPAPPGSRKVVIATNIAETSLTIDGIYYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLSKMLIMSVALQCSDEILTIVSMLSVQNVFYRPKDKQALADQKKAKFNQPEGDHLTLLAVYNSWKNNKFSNAWCYENFVQIRTLKRAQDVRKQLLGIMDRHKLDVVSAERNTVRVQKAICSGFFRNAGKKDPQEGYRALVDSQVVYIHPSSALFNRQPEWVIYHELVQTTKEYMREVTTIDPKWLVEFAPAFFKFSDPTKLSKFKKNQRLEPLYNKYEEPNAWRISRVRRRRN

SEQ ID NO: 11051 - protein, 414 aa, Diabrotica virgifera
MSSKRKSKESIIARVNFPLYTLQMLTSRHVIVGGGGGTSKTGVHNGFEIFEIFHDGTRFAAKEVTRHETGGNVVMNCSVYSDRKYSLLVAGQESECQLYKLNPKLVEEVENIGNNTHLRQRNTKNKEVTDDNKNVTKELYFDVNAIENVQTDFNGSEPLSRVVKINHDGTLLATGGTDGDVRIWKFPSMQPLFILKAHTKEIDDIDFSRFDNYVITIAKDGLAVLWDCMTGKERTKLTWKQPGSKYLYKRCRFGVIEGLDKKCALYTISNPIGVAKKQKSYLQQWIPEENILRRCIEFDESLAALAVRDDGRFVAVGTMFSGSVSILVAFNLQKILTIVGAHSMFVTGLEFLPTQNLNHSISSVVEAAVLSISVDNQLCIHTVPYRKTIPLWIAIALLVLTLFLTFSLCSYLGL

SEQ ID NO: 11052 - protein, 413 aa, Diabrotica virgifera
MAGAMLFERAPSVSSQHEKLLKLSRDSDDEDQNIVNKEQDILNLGEKYKKEGKAKELAELIKATRPFLSLISKAKAAKLVRSLVDYFLDLEAGIGIEVQLCKECIEWAKEERRTFLRQSLEARLIALYFDTGMYSEALQLESTLLKELKKLDDKNLLVEVQLLESKTYHALSNLPKARAALTSARTTANAIYCPPKMQAALDLQSGVLHAADEKDFKTAYSYFYEAFEGFDSVESPKALTALKYMLLSKIMINSPEDVQQIVSGKLAFKYAGQDIEAMKSVAQAAHKRSLADFQQAVKQFKHELEDDVIVRAHLGTLYDNMLEQNLCRIIEPYSRVQVEYVAKTIKLPVLQVEKKLSQMILDAKFHGILDQGEGVLIVFEESAVDKTYEMALETIQSMSKVVDTLYQKAKKLS

SEQ ID NO: 11053 - protein, 588 aa, Diabrotica virgifera
MASKSKKGSTPLASQRPASPLSPTRHSRLQEKHELQNLNDRLAGYIDRVRYLEGENNRLTREIQSTQETVTREVSNIKSMYDHELSDARKLLDETHREKARLEIDVKRLLEENDELKSELAKKNKDLALAENSARIYETRCNELQLKANQAAADAKKAIADAKELEKERDKLRKLLDNHRKQLEEESLARVEVENANQSLREELSFKDQIHQQQLTETRTRRQVEISEIDGRLAEKYEAKLQEALQELRDQYESQMANNRGEIELLYEQKIKNLQSANDRHAASASGALDELRQVRTRIDTLNSRISDLENQNAGLAARARDLEKLLENERMRHVEDLAMLERELHRLREEMANQLQEYQDLMDIKVSLDLEIAAYRKLLESEEARLNITPTGSEVHEVTHSRSQRSSSQRRTPVRLGAKRKRTLLEESQESSMNDYTVNSSSKGDIEVADVDPEGHYVKLHNKSNQEVALGGWQVIRRVGEEETTFKFHRSLKLEGNGFVTIWSSDLNKDHEPPTNLVMKSQKWVVGDNMVTTLLNNNGDEVAVSERVKRQLTSSHLRHRELAAGYLSEELHHQQGDPQVDERCRLM

SEQ ID NO: 11054 - protein, 803 aa, Diabrotica virgifera
MAENKNPEDLATAILRKKDRPNRLLVEEAVNDDNSVVALSQAKMDELQLFRGDTVLLKGKRRKETVCIVLSDDTCSDEKIRMNRNVRNNLRVRLSDVVSIQACPDVKYGKRIHVLPIDDTVEGLTGNLFEVYLKPYFLEAYRPIHKDDVFVVRGGMRAVEFKVVETDPAPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSEAALQQIREKMDLIDLEDDQIDAEVLNSLAVTMENFRYAMTKSSPSALRETIVEVPNVTWDDIGGLANVKKELQELVQYPVEHPDKFLKFGMQPSRGVLFYGPPGCGKTLLAKAIANECQANFISVKGPELLTMWFGESEANVRDIFDKARSAAPCVLFFDELDSIAKSRGGNVGDAGGAADRVINQILTEMDGMGAKKNVFIIGATNRPDIIDPAILRPGRLDQLIYIPLPDEKSREAIFKANLRKSPVAKDVDLVYIAKVTHGFSGADLTEICQRACKLAIRQSIETEIRRERERALNPNVAMDLDDDDPVPEITRAHFEEAMRFARRSVSDNDIRKYEMFAQTLQQSRGFGTNFRFPTAAGGPAAPGGTGGDQANFQDDPEDDLYS

SEQ ID NO: 11055 - protein, 274 aa, Diabrotica virgifera
MGDQFDCALDLMRRLPPQQIEKNLSDLIDLVPSLCEDLLSSVDQPLKIAKDKETGKDYLLCDYNRDGDSYRSPWSNTYYPPLEDGSMPSEKLRKLELDANLAFDQYREMYFEGGVSSVYFWDLDHGFAGVILIKKTGDGSKKIKGCWDSLHVVEVQEKSSGRNSHYKMTSTAMLWLQTNKQGSGTMNLGGSLTRQIEQDAAVNDINPHIANIGRMVEDMENKIRNTLNEIYFSKTKDIVNSLRSVQPLTESRAQQALKQDLAAALQRRQNKTEN

SEQ ID NO: 11056 - protein, 1388 aa, Diabrotica virgifera
MERPPRNEPTVDPVNGVVQPLVQPPPESPGRVTNQLQFLQKTVLKAVWKHQFAWPFQQPVDARKLNLPDYHRIIKQPMDLGTIKKRLDNNYYWSGKECIQDFNTMFTNCYVYNKPGEDVVVMAQTLEKVFLTKVADMPKEEFVVESPGKAGAAKGKKGRTSTAGAVSAPPTPTTATAGSGGRGRPPATVSSTSATPVATTTGSSGLPLGTQAPATVPGSTATTTIAAASTNNSSLSNQQLNSSSSSIHGSGSSLGNSLDSSSVMPANVIPPAQPAKVKKGVKRKADTTTPATAYDYPPTLESKSAKISTRRESGRQIKKPTRPELDGHPPQPPPLKPKEKLPESLKACNEILLELFSKKHSSYAWPFYQPVDAELLGLHDYHDIIKKPMDFSTVKNKMENREYRTPQDFAADVRLIFSNCYKYNPSDHDVVAMARKLQDVFEVKYAKIPDEPVNRVGAPAVNNIPAKSETSTSGSSSDSSSDTEDSEEERRNKQLKLLEKELTAMQEKMRKLVDESSKKKKEKKKDKVKKKPTSGGSLANASLSTLPNSSSAGLGKPGAGGHGALNKSNNNNSIAADSVDDSIASVVSGADLKMAESHHPQTGTGAHHPPAGKSLNMHHNMTANAGANASAQAKTPKSKGLRGNKPAAATNAAPNKRVKANNKAGAGRKKNAAQPPPMQFDSEDEDNAKPMSYDEKRQLSLDINKLPGDKLGRVVHIIQSREPSLRDSNPDEIEIDFETLKPSTLRELESYVASCLRKKPHKKVAGKSKDEQIAEKKQELEKRLIDVNDKIGNSKKAPKKDEANKVDPTGAGGPSGRLSSSSSSSDSDSSSSSLSSSSSDSSDSEAGGTANRQAKKKANKKSPNPSLGSSTTTTTIKVPPPQTTATPAPPSQAAPAITTAATANLTTTVTVPPLTTTTTNTIAPPIQPAPVPNVAVPAQTTPAAPAFTPSITIKPSLQAAPIAPTVPPLIKSIEKLPVTTLLPPTVPTITPPTVPQAPKSVALPTPSPDKPKPNIISPIGTFTDPIEQSLASLEHDIKQNDPMDVITASTMMQMPTTLTNPIVSHPHPNLNLNPTINHPILQPSTLSMDLKAPIMGTMAPSNTMLHHGLQQAMETDISIPPPPTNMLHGQNNGFGMKHNFDLTTNNNGLSSMGLPMEMSISSMFDPIPQNINPMMKNDSQLKMDDRMDTLGGLLNDKKSNLLIQKPMSQSFGFKNDKPDHNVKNASSWSSLAKGKSPQNNIPGGSSKQQVMDSFKAFQNKAKEKADREKQRLENLEMKRQQREQAERERLRAENERRREREEEDALEKARKAVAEQQQPIASQRVEELRSSPGEGSTSPGSLSSGSERISERERQRLQEQERRRREVMANKIDMNMQSDLMAAFEGSL

SEQ ID NO: 11057 - protein, 407 aa, Diabrotica virgifera
MSLSTARPLVSVYNEKSEEVKGSNISLPAVFKAPIRPDVVNFVHQQVSMNHRQPYSVSDKAGHQTSAESWGTGRAVARIPRVRGGGTHRSGQGAFGNMCRGGRMFAPTKPWRRWHRRVNINQRRYALASAVAASGVPALVMSKGHVIDQIPELPLVVSDKVQEMSKTKQAVQFLRRIKAWADIQKVYKSQRFRAGKGKMRNRRRIQRKGPLVVYYKDQGLRRAFRNIPGIDLISVQKLNLLKLAPGGHVGRFVIWTESAFQRLDKLFGTWKTASLEKKGYNLPQPKMANTDLSRLLKADEIKAVLRAPQKKVVRRVRRLNPLTNAKAMLKLNPYAAVLKREAILKNQKRQLNREELLAKKRGITVSADNVVIRSRKLQERRRAQILKDKKSKPKKAKKAPAKAAGKK

SEQ ID NO: 11058 - protein, 1823 aa, Diabrotica virgifera
MADFIDSEAEESSEEEELDHRDRKKAQKAKVVDSSDEDDEDDDERLREELKDLIDDNPIEESDAESDASGREKRKKSDDEDLDDRLEDEDYDLLEENLGVKVERRKFKRLRRFEDEESEGEEEHDPEQDREQIAMDIFSDDDDERRSERSHRPAVEQETYGVGEEEEEGEYSDADDFIVDDDGRPIAEKKKKKKPIFTDAALQEAQETFGVDFDYDEFSKYDEDDYEDEEEEDDEYEEDDVEKRKRPKKTSKKKPTKKSIFEVYEPSELKRGFFTDLDNEIRNTDIPERMQLRDVPITAVPDDSTELDDEAEWIYRQAFCNRTVSNVDSHLSSEAREKLKKTHHAIGKIRKALDFIRNQQLEVPFIAFYRKEYVQPELNINDLWKVYKYDAKWCQLKTRKENLLKLFEKMRSYQTDHIMKDPDAPIPDNLRIMTESDIERLKNVQTAEELNDVHNHFILYYAADLPAMHAAWRVKERERRRQERKEARLKLIAESEEGAEIPEEPEEIDDDEPEAETLKYANRSGSYALCNKGGLGPLAKKFGLTPEEFAENLRDNYQRHEVDQEHIEPVEVAKEFVSPKFPTVEEVLQATKHMVALQIAREPLVRKCVREIFFERARLNVYPTKKGVKVIDEAHNCYSMKYVKNKPVRDLAGDQFLKLCLAEEENLLTITINDHIQGNTTNNYIDEVKQLYIKDEFSKHVQDWNALRMESVERALTKSVLPDLRSELKRTLLTEAKEFVLKACCRKLYNWIKIAPYAITFPDEDEDDWDTSKGVRTMGVAYVPEHTVSAFTCISAPDGDITDYLRLPNILKRKNSFRTEEKLMKEADLQALKNFIFLKKPHVIAVGGESREALMIADDIRGVISELIESDQFPQIRVEIIDNELAKVYANSIKGSTDFRDYPELLRQAISLARRMQDPLVEFSQLCNSDEEILSLRFHPLQEQVQKEELLEALCLEFVNRTNEVGVDINLAVQQIHKSSLVQFICGLGPRKGQALLKVLKQTNQRLENRTQLVTFCHMGPKVFINCSGFIKIDTNSLGDSTEAYVEILDGSRVHPETYEWARKMAVDALEYDDDEGANPAGALEEILEAPERLKDLDLDAFAEELERQGFGNKSITLYDIRAELNSRYKDLRQPFRSANPEELFDMLTKETPETFYIGKMVTSTVFGIARRKPKSDQLDQANPVRNDETGLWQCPFCLKNDFPELSDVWNHFDAGACPGQATGVKLRLDNGILGYIYIKNISDKPVANPEERVGIGQLIHCRIIKIDVEKFSVDCTSKSSDLADKNHEWRPQRDPHYDQEREDKDNRLEAEKKKEKQRMTYIKRVIVHPAFHNISYAEAEKCMVNMDQGEVIIRPSSKGADHLTITWKVTDGIYQHIDIKEQGKVNAFSLGKSLWIGNEEFEDLDEIIARHVTPMAAHARDLLYFRYYKDFQGGHKDKAEEYLKDEKKKNASKIHYVVSAAKNIPGKFLLSYLPRNKVRHEYVTVTPEGFRFRQQMFDSVSSLFKWFKEHFREPPPGGATPGSTPRMASSRTGYGSATPAYSMNNEAIQRVAQNLPSHVVQALSAATNQTPHYPHTPGYGGNYINTPYTPSGQTPYMTPYATPHTQQTPRYGHQTPSQHMASSAPQGLNNPFLHPGAVTPSQRTPIYRNHPAQSPVMLPTSPVPSPGSQSSYSSHLSHNQRSGSYAESLRFQPPESPRSSVSNRSFQTDRYGGDRYGKGGSHRYGGSSNEDRYGKGGGGNENTDWQKAAEAWARSRSTPRSDGRNTPRSVGQRTPRYDNDAERSRMKHLSKSPRSVRSTPRTNTSPHSMSLGDATPLYDESI

SEQ ID NO: 11059 - protein, 820 aa, Diabrotica virgifera
MPDTKDTNTKDANLSSPERKRRRKSRSKSPERKEKKSSKKKAHNSRDRDSSEEGYNPKDYQRYYGEDRPNSDKYWNKYPRKDTTKVGQRYYDAAPEESGKKGPDRNSEEKELPKPMESVPDKSVIKPRERKTVDMLTSRTGGAYIPPAKLRLLQASITDKTSAAYQRIAWEALKKSVHGYINKINTSNIGIIARELLHENIVRGRGLLCKSIIQAQAASPTFTNVYAALVAVINSKFPSIGELLLKRLVLQFKRGFKQNNKSICISATTFVAHLVNQRVAHEILALEILTLLVETPTDDSVEVAISFLKECGQKLTEVSSRGITAIFEMLRNILHEGQLEKRIQYMIEVMFQIRKDGFKDHAAVVEELDLVEEEDQFTHLIMLDDVKEADAEDILNVFKFDESYEENEDKYKTLSKEILGSDGESESGSEGSEEESDNENEDEVKDQGTIIDNTETNLISLRRTIYLTIQSSLDFEECAHKLLKMELKPGQEIELCHMFLDCCAEQRTYEKFYGLLAQRFCQINKVYIEPFQQIFKDTYSTTHRLDANRLRNVSKFFAHLLFTDAIGWEVLDIMKLNEEDTNSSSRIFIKILFQELAEYMGLGKLNARLKDETLQAYFSGLFPRDNPKNTRFSINFFTSIGLGGLTDELREHLKNIPKMMEMKLATKEKESSGSSSSESSSEEDSSDDSSEDSSSSEDDRGKKKKKTKKLEEKNSKVNSKSRPRSKEKEHADKPRDKHRKEDRHKSDKNPDRSSSKKYSKEDNKRKKDYEWMKSRYEDDIKQLKNDKRVFEKSSKRRSRSRDRVKVKEERRRRSRERRRS

SEQ ID NO: 11060 - protein, 497 aa, Diabrotica virgifera
MNDFEPPRQMYRGAHVFFTEVCPEELFNELCKSCAARKIKTLKEINIAFLPYESQVFSLDSPDTFQCSYDPSFSAARNANMERMAEQIATLCATLGEYPHVRYRTDWERNVELAQLIQQKLDAYKADEPTMGEGPEKARSQLIILDRGFDCVSPLLHELTFQAMAYDLLPIENDVYKYEASAGVMKEVLLDENDELWVDLRHQHIAVVSQSVTKNLKKFTDSKRMTQSDKQSMKDLSTMIKKMPQYQKELSKYATHLHLAEDCMKAYQGYIDKLCKVEQDLAMGTDAEGEKIKDHMRNIVPILLDPKITNEYDKMRIIALYAMTKNGITDENLSKLATHAQIKDKQTIANLQLLGVNVINDGGPRKKQYTVPRKERITEQTYQMSRWTPIIKDIMEDCIDDKLDQKHYPYLSGRAQSTGYHAAPSSARYGQWHKDRGQQAVKNVPRLLVFVVGGISFSEIRCAYEVTNAQKNWEVIIGSSHILTPEDFLSNLATLAG

SEQ ID NO: 11061 - protein, 712 aa, Diabrotica virgifera
MMQQYMKELEQEPFDAEEFVERLAWRTLAESKGDGEEHEINPALLHESFVQAIKDLNLLHERQQKKCEKLEVVVREDEATFFQEIYNLLEQNKQAMDTFQELDGKINHVATKVLHLGDQLDSVNGPRSRVVDALKLMIHLTEFLSDESVLSPIFTRPELIDDAADVIQKLYLISQDLPPKFDVAKRKIERKYSDIEKSLIEEFVLAMDNENLNRMKEIATVLSQFKGYSQCVDAYIDHSQMGCLSSKDVFANFLTLCKYNHEIIVKVFNNPEQVMAKFVLNIFQLKLVEYIDQRLNSKLGTYGYLQVLYELYYKTNQLSNDLSIFNMGNDKNFLSKLTTNIFNKYISDYITMELKGLKDRCSANLQKYYESKGHQKKQIQSGGFQDLRRDLQAVIGTRANINIAQIENYGGETFLSEELAITILQDTKHAFQRCQLLSKPTDRASNATQILDRLINSLLVEHVDYAVELGLQAVPVVEGTKTPPALYFFSVVHHSNNIIHLVEKQFMDLLVPLVENTPRHNDCVQKKKFVLEDIERKINTGLDRCLNAISSWVKLYLQTEQKKSDFKPESDDFDTVASNACKNVINYVNSIVKEIKANLDGNNVTAILQELGIRLHRVVYDHMLQFQYNTAGAMVAICDLNDYRHCTKALGPLVIELFDTLHALCNLLLVKPENLQQVCSEDSLVKLDRTILHNFIQLRSDFKVQKQMILKV

SEQ ID NO: 11062 - protein, 270 aa, Diabrotica virgifera
MDFQNRPGGKTGGGGVASWSETNRDRRERLRQLALETIDLQKDPYFMKNHLGSYECKLCLTLHNNEGSYLAHTQGKKHQANLARRAAKEAKDAPTLLQPEKPRVEPKKFVKIGRPGYRVTKQRDAESGQQSLLFQIDYPEISDMILPRHRFMSAYEQKIEPPDRKWQYLLFAAEPYETIAFKVPSREVEKTDSKFWTHWNKDTKQFFLQFAFKNDNKRTVNTVVQRHTIVGAAPPPPMLPVPPPPRPPMFNPIPPPPPIMRAVLPVPPPH

SEQ ID NO: 11063 - protein, 134 aa, Diabrotica virgifera
MSIGVPIKVLHEAEGHVITCETITGEVYRGKLIEAEDNMNCQMTQITVTYRDGRVAQLENVYIRGSKIRFLVLPDMLKNAPMFKKQTKAGTAGRGKSAILRAQARGRGRGQQQPMRGRGNWQQNQQQAPAGRGR

SEQ ID NO: 11064 - protein, 488 aa, Diabrotica virgifera
KKLTVVLSLLSVCAVTSVRLCCQVINSENFGKKDICFISFHTPSLRSMASTLTRTPILRAISARSYSQALPVSGNPSAELRTSTLPNKLVVAAVDNDASLTRVSIVFRAGSRNEKADNLGATHIVRTAAGLSTKNASQFAIIRNIQQVGANLTATSDRETISYTLEGTRSAVEKALPYLAEVATHQEFRPWEVSELSNRLILDILTRPLQLRAIDLLHNAAYRSKGLGNSLFIPKSQVGKVSSETLQHYVASNFVAGRAAVVGTGVSESLLNQFAASLGIANGEGSTNPSPYKGGELRSNKGGPLAFVAVGGEGAPLKNTKEALAFAVLQKAVCAGPQIKYGVLDNGVYSKALGGSSDVSACAVNVSYSDSGLFGILLAAPAGSVGKAVQSAVNVLKSGSVTDADVQRGKNQLKTAILLNAESGADVVRELGTQAVLAGAPQSANALAAAVDSVSTSDVQSALRKAGGKLTLAAIGNINDVPYLDELK

SEQ ID NO: 11065 - protein, 143 aa, Diabrotica virgifera
RQSIFIQKTKFCKYIFSPFFKVIKPYLTVAAYKMRRAHAGNYYEPLPQASNEIEDENDRMTNDLQEKIGVLKSLTIDIGNEVKYQDRMLRDVDDDLDKTGGFLGTTMSRVLRLSKGSHNYLILYLFVFSVVVFFILYLVIKFR

SEQ ID NO: 11066 - protein, 494 aa, Diabrotica virgifera
MASTISARQANREHVLAVSRDFISQPRLTYKTVSGVNGPLVILEDVKFPKFNEIVQLRLSDGSLRSGQVLEVSGSKAVVQVFEGTSGIDAKHTVCEFTGDILRTPVSEDMLGRVFNGSGKPIDKGPPILAEDYLDIQGQPINPWSRIYPEEMIQTGITAIDVMNSIARGQKIPFFSAAGLPHNDIAAQICRQAGLVKIPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHSDVSNQLYACYAIGKDVQAMKAVVGEEALTPDDLLYLEFLTKFEKNFITQGNYENRTVFESLDIGWQLLRIFPKEMLKRIPASTLAEFYPRDSRH

SEQ ID NO: 11067 - protein, 390 aa, Diabrotica virgifera
MSRGHAGPRIHVPDELREVLLEFTISYLLEQPGDVISYAAEYFTRLRETRVTSRVYDEAAASQEELVSPDESVMSKDEEPSIRFAGRRKSVFAETYDPEEDDDDDDGAKLVYPKSDEQRQRLATAVKNILLFRSLDKDQMNDVLDAMFERVVKKDELVIKQGDDGDNFYVIQSGTFHVFVAPDPSKEPNHIHTYENSGSFGELALLYNMPRAATVKANSEGSLWAMDRQTFRRIVLKSAFKKRKMYEALIESVPMLKTLQPYERMNLADALVPRVFYDGDRIIKQGDAADGMYFVEQGEVAISVLDDSGKEVEINRISKGGYFGELALVTHRPRAASAYCDGEVRCAFLDVEAFERLLGPCMEIMKRNITDYEEQMLKIFGSKQNIRDIR

SEQ ID NO: 11068 - protein, 806 aa, Diabrotica virgifera
MSYMQSNQNRPMSQSYHQGPNDLPMQSSKEQTLLWQQNSYMGDSGIQSGAATQVPSLTGKEEEEMDLFDLDQPYQGFTQEQVDDMNNQLNHTRSQRVRAAMFPETLDEGIEIPSTQFDPNHQTAVQRLAEPSQMLKHAVVNLINYQDDADLATRAIPELIKLLNDEDQVVVSQAAMMVHQLSKKEASRHAIMNSPQMVAALVRAISNSNDLETTKGAVGTLHKLSHHRQGLLAIFKSGGIPALVKLLSSPVESVLVYAITTLHNLLLHQDGSKMAVRLAGGLQKMVALLQRNHVKFLSIVTDCLQILAYGNQESKLIILASQGPIELVRIMRSYDYEKLLWTTSRVLKVLSVCASNKPAIVEAGGMQALAMHLGNPSTRLVQNCLWTLRNLSDAATKVDGLESLLQSLVQVLASSDVNVVTCAAGILSNLTCNNQRNKVTVCQVGGVDALVRTIVSAGDREEITEPAVCALRHLTSRHVESEMAQNAVRLNYGMQIIVKLLNPPSRWPLVKAVIGLIRNLALCPANHAPLREHGAIHHLVQLLMRAFQDTQRQRASVASGGSQPPGTYADGVRMEEIVEGTVGALHILSRESHNRAIIRQQMVVPIFVQLLFNDIENIQRVAAGVLCELAADKEGAEMIEQEGATAPLTELLHSRNEGVATYAAAVLFRMSEDKPQDYKKRLSMELTNSLFREENLWNPDLGMGPDLQDILSPDQAYDNMYAQGPPSVHSSHGGRPYQQQGYDQIPIDMQGLDIGSHGGGNGSTYSAIDAMDVTSGDPDLNFDTIDQLPTPPQDNNHAAAWYDTDL

SEQ ID NO: 11069 - protein, 272 aa, Diabrotica virgifera
MARNAEKAMTTLARWRAAQLGEIDKHKKRRPYLASECKNLHACEKWRMQIIREIAKKVAQIQNAGLGEFRIRDLNDEINKLLREKRHWEDQIKELGGPDYQRVGPRMLDHEGKEVPGNRGYKYFGAAKELPGVRELFEQEPPPPPRKSRAELMKDIDADYYGYMDDDDGILIPLEVKAEKTAVQNTVAEWVSKKEQNLENAENQTEEESIYAVQESDDEESKETVQQLVDGSQQRFVAHVPVPSQQDIEQALLRRRKLELMEKYGVEEEPKS

SEQ ID NO: 11070 - protein, 215 aa, Diabrotica virgifera
MAGEQDMPTFKCVLVGDGGTGKTTFVKRHMTGEFEKKYVATLGVEVHPLVFHTNRGQIRFNVWDTAGQEKFGGLRDGYYIQGQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAAPALLPPEVQMDPQWQQQIEKDLKEASETALPDDDEDL

SEQ ID NO: 11071 - protein, 836 aa, Diabrotica virgifera
MPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEEGEDAVDDPRKLKPGEIDPNPETKPARPDPKDMDEDELEMLSEARARLANTQGKKAKRKAREKQLEEARRLAALQKRRELRAAGIEVTSRRKKKRGVDYNAEVPFEKRPAIGFYDTSNEVLDPMAPDFSKMRQQHLDGELRSEQEERERKKDKQKLKQRKENDIPQAMLQNQEPAKKRSKLVLPEPQISDQEMHQVVKLGKASEAAREIVTESGVETTDTLLNDYTFNPQAAATPRTPAPQTDRILQEAQNMMALTHVDTPLKGGINTPLHNSDFSGVLPQAQTVSTPNTVLATPFRSSRSDGAGTPGSSVGFMTPRSGALVPVGKTPVGMTPSVRDKLSINPEEAMDVGSTPAEHRMYQMSMKDQLKMGLSSLPQPKNDYEIVVPENEDQEEPEQAQSQMIEDQADVDARKQEELKAKAARELALRSQVIQRDLPRPQEVNMTVLRPSHESYSLSDLQRAEELIKREMVTMLHFDNLKNPVPTQSKRSNMSQAHQLAFLEQHPYESFRKEDLGVAKGILKREMEVVRNGMNHGELPIEVYTQVWEECLSQVLFLPNQTRYTRANLASKKDRLESAEKRLEQNRSHMAKEAKRAAKMEKKLKILTGGYQSRAQVLIKQLQDCYENLDSTNLELNTFKFLQEQEKSALPRRIQSLTEDVSRQTERERGLQKKYGDLQAEIKYLQESYLSQLQKEQRKEADNTANEVSSTTNGELNAETVDDDEEMQ

SEQ ID NO: 11072 - protein, 157 aa, Diabrotica virgifera
MMQFMLLFSRQGKLRLQKWYVAHPDKLKKKITRELITTILARKPKMCSFLEWRDLKIVYKRYASLYFCCAIEQCDNELLTLEIIHRYVELLDKYFGSVCELDIIFNFEKAYFILDELMLGGEVQETSKKNVLKAIAAQDLLQEEETPQGFFDDHGLG

SEQ ID NO: 11073 - protein, 416 aa, Diabrotica virgifera
MYGLQRISYRIYIRNGFRHYSQQPAKRNSFIGRLFENFKDEMAKNKEMKESLKKFREEAQKLEQSDALKAARQKFESVEKEASKGSEVFKESLGSVKERLKGVIDEASKSDLAKKAGKFTEEVGKTTHKISETAQEISKTGAFQSISQATKAVKQEIDNTSIEGRVYVSPKILRKRTETSAVVHQKYYEPNTDATGVELHKDSKFYESWQNFKDNNPYVHKVMDWKLKYDESENPVIRASRALTEKVGDIMGGLFQKTELSETLTEICKIDPAFDTKRFLKQCETDIIPNILEAMTRGELEVLKDWCHEGPFNLFAVPIKEAYKKGYKIESKILDIDHVDLVLGKVMDQGPVLIISFTSQQVMAVRDASGGVVEGDPDKVMRVNYVWVLCRDVTEPDPRAAWRLLDLSASSNEQLV

SEQ ID NO: 11074 - protein, 309 aa, Diabrotica virgifera
MSSDSELSDSDIELQQAFADGKLQPGLNTVEEGPKQFTNNVSGLKQKLEEIKLKLPWIERLDCVNAQAPLAPELAAQMLTHEEKRSNELKNNKKLTQFTPSEDPVLNDFKREMMFHRQAQAAILDSIPKLKDMGILTKRPDDYFAEMAKTDAHMQKIREHLMKKQEQQKRSERVKQLRQQRKEGKMLQVQTKLQRQQEKKDMLAQVKKVRKGMSKDLDFLDGKNKSAAKKMAEKRKMKDKKFGFGGKKKGMKRNTRDSAADISEFKNPGKPGKKFNNSGKGVKGGKMGQGAKQRMGKSKRIKMRSKGRK

SEQ ID NO: 11075 - protein, 1238 aa, Diabrotica virgifera; identical to SEQ ID NO: 11050

SEQ ID NO: 11076 - protein, 621 aa, Diabrotica virgifera
MNPAAPNYPMASLYVGDLHSDITEAMLFEKFSTAGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDENSSSKGYGFVHFETEEAANKSIEKVNGMLLNGKKVYVGRFIPHKEREKELGEKAKLFTNVYVKNFGEDFAEEQLKVMFEKYGKITSYKIMSKEDGKSKGFGFVAFESSEAAEAAVEALNGKELVEGKPLYVGRAQKRAERQQELKRRFEALKMERLNRYQGVNLYVKNLDDTIDDERLRKEFTPFGTITSAKVMLEEGRSKGFGFVCFSSPEEATKAVTEMNGRIVGSKPLYVALAQRKEDRKAHLTSQYMQRMANMRMHQMGQFIQPGASSGYFVPTIPAAQRFYGPAQMTQIRASTRWAAQTTVRQGAQGGTTVYPGMQNTYRATARPPNQSTTMRSNMSVPRQITGQQPQNAIVPAAVNRTANFKYTSNMRNPPQPLGGLPGAAAPVQQAVHIQGQEPLTATMLAAAPPQEQKQMLGERLFPLIQRMYPDMAGKITGMLLEIDNTELLHMLEQQESLKNKVEEAVAVLQAHQAKQAATTQIKKE

SEQ ID NO: 11077 - protein, 913 aa, Diabrotica virgifera
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSGLVEDQGFLEQLKELLSDSNPMVVANAVAALSEINESSPTGQPLVELSTNTINKLLTALNECTEWGQVFILDSLSNYTPRDEREAQSICERITPRLAHANAAVVLSAVKVLIKMMEILAGDTDFCNTLSKKLAPPLVTLLSSEPEVQYVALRNINLIVQKKPDILKHEMKVFFVKYNDPIYVKLEKLDIMIRLASQVNIAQVLSELKEYATEVDVDFVRKAVRAIGRCAIKVEPSAERCVATLLDLIQTKVNYVVQEAIVVIKDIFRKYPNKYESIISTLCENLDTLDEPEARASMVWIIGEYAERIDNADELLDSFLEGFGDENAQVQLQLLTAVVKLFLKRPQHTQGLVQHVLSLATQDSDNPDLRDRGFIYWRLLSTDPAAAKEVVLADKPLISEETDLLEPTLLDELICHISSLASVYHKPPTAFVEGRSAGIRKSLPARQGSAEDTSSAPEPTVIPNQESLIGDLLSMDLNAPAPAAAQAAVPASNVDLLGGGLDSLLDIGTTPAPPTSTGLLGDIFGIPTAPTMYTPPKTIWLPAEKGKGLEIHGAFSRRAGQMSMDLTFTNKAMQAMSAFAIQFNKNSFGIVPGSPLTVPALQPGQSLEYNLALATTGPVQRMDPLTTLQVAIKNNVDIFYYACQIPIQILFTEDGTLDKRVFLTTWRDIPAANEVQYTVNDVKGNTDGVSSKMTLNNIFTIAKRNVEGQDMLYQSLKLTNNIWVLLELKLQPGLTTATLSLKSRSVEVAPYVFQAYDSILKN

SEQ ID NO: 11078 - protein, 165 aa, Diabrotica virgifera
MPPKFDPTEIKYVYMRCVGGEVGATSSLAPKIGPLGLSPKKVGDDIAKGTADWKGLKITVQLKIQNRQATISVVPSASSLIIRALKEPPRDRKKQKNIKHTGNITFDEIIAIARQMRPRSMAKQLSGTVKEVLGTAQSVGCTIDGKAAHDVIDEVNEGTIEVPDE

SEQ ID NO: 11079 - protein, 364 aa, Diabrotica virgifera
MPEEGKRALILVGGYGTRLRPLTLSRPKPLVEFANKPILLHQIEALVDAGVTEVILAVSYRAKQMEEELTVEAKKLGINIIFSHETEPLGTAGPIALARDHLSKSTKPFFVLNSDIICDFPFKALAEFHKNHGKEGTIVVTKVEEPSKYGVVVYDKDNSIQSFVEKPQEFISNKINAGLYILNPSVINRIELKPTSIEKEVFPYMAADKQLYAFELEGFWMDVGQPKDFLTGMCLYLKHLRQTNEDKLYKGPGVVGNVLVDPTAKIGNNCQIGPNVTIGPGVVIEDGVCIKRSTILKDATISSNSWLESCIVGWKCCVGRWVRMEGSTVLGEDVIVKDETYINGGQVLPHKNIATSVPEPQIIM

SEQ ID NO: 11080 - protein, 291 aa, Diabrotica virgifera
NLNMASDGDDVISDQEKVKIVSDFILHSPPGEFNEVFNDVRKLLNDDDLLKEGASGAFAQYNKDQLTPVKIENADHLVLITEYNDLGNNRFFDPRSKQSFTYDHLRKEALDYQVYTPDSASEPWRAALDSEFIQYTRNHYKDGVCSVVGRNQSGVVNLTACIEDHQFSPKNYWNGRWRSQWSISLTDDSTAEVRGVLKVQVHYYEEGNVQLVSTKEIKETVPVSSEAQTAKEIIQVIEAAEDLYQTAISENYQNMSDTTFKALRRLLPVTRTKMDWNKIVSYSIGKELKTQ

SEQ ID NO: 11081 - protein, 1356 aa, Diabrotica virgifera
MWFKYFVIFVLFSVSVKGLDGDLPPDVETIDVDTTNVSNADPDAGKPIPVEDTPNGAPPVNTNYEVDKTLVNVTNSLVNVTKNPRRTYQTVNKMGKYSTFYAADYDPMTSDTAPPDTDQRGGGGTPYTISEPRLAEIRKHFMYPFFDKGGSDNNLGDFQKDIQSSIPQVHKNLNFQLPFFGFRYNYTRVSVNGYLEFSDPPPNYDYPLVFPIKEWPKKNDPAFIGIFFSRCRIGNLRDGDIDQRTPGVYFRMERDLRTRQDRMGVEIRERLKWDIRTGVIGSETFDPKHAVIVTWKNVTFTGGFANAKYKTNTFQMVLATDEVFTYAMFNYLNLDWTSHTEAGGDSQNGEGGVSAYVGFNAGNGTRSYEYNPYSQASVIRDLTSVGFGNGFKGRHIFRIDEDILLGSCNKDIDGANLPLKFAPESGNMLGGTVVNITGPCFNLNDRIRCKFDVSNEVFGYVVDKNRAICVQPQLYAEGWVNLQIAVNSEAFKWKGKYYVESPASATQKIFFKDMKLHEKSPSELKITWEKQNLTTNDNANIRISLWGYRETTMKPVFVYITDIADNVQNIGEHTIVPSQFRTRVNQYLTDIKFGFLQINLTESITVNTYTTSQSSIELTPVIWSRPIPLGWYFQFQWENQYGKNWPKYLCDDWLRTDRYLKNFAHELAQCPCTVEQALADKGRFMPDFDCDKDSNPICYYNNQALHCVKTGSPTLEGSEQQCCYDKNGFLMLSYDQQWGSSPRRCHNLGKMPYNEATKVPTLSQWFNDMVPKYLCCLWQDEQAVGCETLRFERRPTQDCVAYQAPGVAGVYGDPHFVTFDDVEYTFNGKGEFALVKSVTQTDNLEIQGRFEQMDPNTYGEVRATQLTSVVAKGNNTIAIEVRRRPLDSRWRYRLDVIADNRRLYFDRPSLKFQHFQGVTIYTPSYILNQSEVIIMFDNGAGMEVVDNQGFMSARVFLPWSFINKTIGLFGNWSFNKEDDFTLPDGSRAAIVNNINDMERVYNDFGSKWMLEDVLDPQKGRALFHREFGRTSATYNNKTFKPQFLMNPEDFLPTNRSTDLKRISEICPLKLYECYYDYAMTVDRDLAHYTKNYKATIYQYKETTRRKVVSCGGLETPRFGRKRTFLFVPGTKVTYECIQEFVLVGDQRRECQADGTWNIPEYGYTYCLRQEEYSSRQAAITSGIILAIIIPLVLLLGYVGYKIYERLTSNNQNYDYDTVQKTQNLQQFSRTLSPYREEDEDEKYPQSDTDSLSKKRRSYDKSYRTHEPLPNRPNSEFEEKPLDPYDQTFEDDRVSRTPTGSPTSPTSSIQYTTPYSRPDIIRGNSSKNLNYNDMYAEPIKKPKERISASQSSIVTDV

SEQ ID NO: 11082 - protein, 214 aa, Diabrotica virgifera
MSSSTDLPLSSLMTFFTRARAALVPFYFTFHSIFLLDILIFCRYTRFVSQDLKMRYVAAYLLAVLGGKASPNAADLEKILGSVGVEAEGERVKKVISELSGKSVEELIAQGREKLSSMPVGGGAPAAAGGAAAAAPAAEVKKVISELSGKSVEELIAQGREKLSSMPVGGGAPAAAGGAAAAAPAAEEKKEAKKEEKKVESESEDDDMGFALFD

SEQ ID NO: 11083 - protein, 907 aa, Diabrotica virgifera
MMTDRFGLKWDPKNLEIRTMSVEKTLEPLVLQVTTLVNTKGPSKKKKGKSKRANALVSTVEKATENFIEKGEQIAYENPDITEEMLAAVDEVKKTGHAMSGAAREFSEDPCSSLKRGNMVRAARNLLSAVTRLLILADMVDVHLLLKSLHVVEDDLEKLKNASSNGELLDNIKAFGQNANELMNQAAKRQQELKDPQLRDDLAAARAVLKKHSTMLLTASKVYVRHPELAAAKANRDYVLKQVCEAVNTINDVAQGRTPQPASGPYDGPGELAAALDDFDDHMVMEPLAYNEVHTRPSLEERLESIISGAALMADSSCTRDERRERIVAECNAVRQALQDLLTEYMTNMGNKDKSESLIRAIDNMGRKTKDLRRQLRKAVVDHVSDSFLETNVPLLVLIKAAQNGNEKEVEEYAVVFTEHSNKLVEVANLVCSMSNNEDGVKMVRYAAAQIDNLCPEVINAARILAARPRSKVAQENMDAFKQSWENQVRLLTEAVDDITTIDDFLAVSENHILEDVNKCVLALQEGDSDTLDRTASGIRGRSNRVCNVVTAEMDNYEPCIYTKRVLEAVKVLNDQVMPKFTQRVQVAVQALGNSPPKEVDENDFIDASRLVYDGVREIRRAVLMNRADEDLDPEDVELDENYLIETRSKSSAHTGEHGVDEYPDISGITTAREAMGKMPEEDKQKILQQVEFFRSEKLKFDREVAKWDDTGNDIIVLAKHMCMIMMEMTDFTRGRGPLKTTMDVINAAKKISEAGTKLDKLTRQIAEQCPESSTKKDLLAYLQRIALYCHQMNITSKVKADVQNISGELIVSGLDSATSLIQAAKNLMNAVVLTVKASYVASTKYPRQGTIASPIVVWKMKAPEKKPLVRPEKPEEVRAKVRKGSQKKVQNPIHALSEFQSPTESV

SEQ ID NO: 11084 - protein, 411 aa, Diabrotica virgifera
MSFSFGATPTPPQKTVASGFTLPSNPIVTSTTGFQSSFGSGDNKDQSKPSLFATPSSQPVSFGLTTKATTAPTTLSFGFATPTTVPFGSSTTITPATTPQFGLSLPKASAPATTTFSLLGSAPATTAAAPTGISFGTATTTATTSATGLSFGTPIGTATTTATTSASGLSFGLTTASSTSSAAPTLLSSTTTSTTSSVSASGALSSTTSAPTFATSSLSSTGTLTFSQLEDSINKWTMDLEEQGKFFINQAKQLNAWDTLLISNGEKILTLNSSIEKVKQQQQQLDQELDFVLAQQKELEELIVPIEKELLGIPVTDIDRNQMYQFSEIVDSQLKQMSDDLKEVIEHINEANKEEEASNPLSQISRILNAHMNSLQWIDRSTAQISSHLEQIGKMQDSNRRNHSFNNSMNF

SEQ ID NO: 11085 - protein, 193 aa, Diabrotica virgifera
MFLWDWFTGMLGYLGLWKKSGKLLFLGLDNAGKTTLLHMLKDDRLAQHLPTLHPTSEELSIGNMRFTTFDLGGHEQARRVWRDYFPAVDAIVFLVDANDSSRFVESQEQLNALLSDETLSNCPILILGNKIDLPGAASEDELRTRFGLFGQTTGKGKVARNDLPGRPLELFMCSILKRQGYGEGFRWLAQYID

SEQ ID NO: 11086 - protein, 190 aa, Diabrotica virgifera
MEEINLDLLEKRIEALELKVFPSGDPSTIADKNQTITNILTQVQTFVTTALTCRETITSMLQFYGTLNDYLDPAGGADELEVEAKRHYILQLHPEIKDTLQTHTRILQTLLPFVESENISKVVEMTAQLEEASVSHLSLYGEWRDTMYKMVVALQDFTDIMSSIKVLFSQLDNTLTNLEYSLQPKFVTEE

SEQ ID NO: 11087 - protein, 582 aa, Diabrotica virgifera
MNNTKTQEVYSDLTLFTTPDKFFLEPKNGEELLVIERVTEEISVYKNHRHIIPAASSRKDFCGLLGIINLLSGPYLVIATQRDIVGYISGCAVWRLVKAELIPFRSSLNLSPEKQADNEVYLSMIEQVLTTPFQYFCYDYDLTHSLQRLRDISPDFWKQSLWERADQRFVWNGFLLSPFRNVISKKFCLPLMLGFVSINFCVVNGHSLNWIIVTRRSVFRAGTRLFRRGIDKDGNVANFVETEQIVEYQGDHASFVQIRGSIPLFWQQNPDLRLKPPPTMIDMDPQEQHSTCLKHLEEVATLYGKVVLVNLIDQKGAEGNMEKSFKNAMSSLSYPSARYEPFDFHSECSKMRWDRLKILIDRLALDQDEMGFFLLLRDGSLSSLQDGVFRTNCIDCLDRTNVVQSMLAHRNLEIVLRKLNILHQNQNLEFQYSFEVLFKNVWADNADIISTQYSGTGALKTDFTRTGKRTKAGVFRDGVNSLTRYYKNNLTDGYRQDAIDLFLGYGKPISPLRVDKSWRYITYPSVLLVAVSMFVASAVFPSEYSTESLLFLLFWGSMVYATLHTIFRYGVEFVDRPRLTQS

SEQ ID NO: 11088 - protein, 586 aa, Diabrotica virgifera
MAPTIQQNNQNGTANGVEKRPVKTVEKRSDLICKVKYCNTLPDIPFDLKFIAYPFEPIRFIQYNPTSLERNYKYEVLTEHDLGVSIDLINKDIYAIEPGATLDPADEKLLEEDILTPQDSKRSRHHAKSVSWLRRTEYISTEQTRFQPQTMDKVEAKVGYSIKKSLNNETLYMDRDSQIKAIEKTFEDSKNVIEKHYSKPNVVAVDILPVYPDFSLWKYPCAQVIFDSDPAPVGKQVPAQIEEMSQAMIRGVMDESGEQFVAYFLPTEDTLQKRRDDFVNQIPYQDDEEYEYKMAREYNWNVKSKASKGYEENYFFVARPDGIYYNELETRVRLSKRRVKAGAPPSNTRLIVKHRPMDANEFRMQRYREKQLEPPGEDDEEMEVDEPQEEEATQEEQEQEKGEKSPSRSRSRSNSSNRSRSRSKSRSKSRSKSRSKSRSKSRSRSKSKSQSRSRSRSKSRSRSHSRSRSRSKSRSKSRSRSKSKSKSKSRSRSKSQSKSPSRSRSRSRSKSKSRSRSASGSRSPSGSRSRSPSKSKSRSRSRSRSGSKSASRSRSSSKASSKSGSRSRSGSRSGSGSESGSGSESD

SEQ ID NO: 11089 - protein, 419 aa, Diabrotica virgifera
HSCPLLCLSRQKFVGHFDLKESSFHSQLNKMPIENLEDQGLEKNPDLELAHCKFLLTLPEYRSDKNVHSKITEAIKKDDMAPWYELICKDAGWKLDANLLSALKAKNAEKIKLLDEAIEDAEKNLGEMEVREAYLRKAEYYSRIGDKDNAVSTFRQTYDKTVSLGHRLDIIFHLIRIGLFFMDHDLITRNIEKAKTLIEEGGDWDRRNRLKVYQGAYCMSVRDFKSAANLFLDTVSTFTSYELMDYKAFVRYTVYTSIISLPRNQLRDKVVKGSEILEVLHSEPFVKDYLFSLYNCQYAEFFTNLAEVETVLRKDYFLNPHYRFYVREMKILAYTQLLESYRSLTLQYMAEAFGVTVEYIDKELSTFIAAGRLHCKIDRVGGIVETNRPDLKNAQFNSVVKQGDLLLNRVQKLSRVINI

SEQ ID NO: 11090 - protein, 1776 aa, Diabrotica virgifera
MEEITSGLDPDELMDLDEPEGSDLDEDEEDLIDDHISSPFILSSAPGSTTNSVASSPISEEFPPPFSFSGKPLNVKRGRGRPRREGGKPGLPRVVRGGGTGMTRVRKPRPPGFSRRGMGNRSVRQPDRSDFDFSPFTPSPIDEQAILDPETGALLYPEREKLLPSMEEPPYFPEHWPGKVCAFCNLGERSQLGQGEMLRLNCPEGFLPHKVAAEQILEKALQAPDKDRGDKSPKGPVTCRRQKGFNKCRHPSMNSEYVDELTIIGYNEVCDVTSLFEPNGQFYVHRNCALWSNGVTRAENSALLDVGPVVLQCSSKKCSLCNHYGASVTCNLDSCNKVFHFPCATAAGAFQEIMSISTFCSNHIGQVAMLNEATPCFTCRTMGDISNLMYCSTCGAHYHGTCVGLAQLPGVRAGWQCRKCRCCQVCRTVGDESKLMSCEQCDKVYHAGCQRPIVTSIPKYGWKCRCCRVCGDCGSRTPGAGLSSRWHAHYTVCDSCYQQRNKGFSCPLCHKAYRAHAHREMVQCSNCKKFVHGTCDAEADVATYHQKKDLNPEYEYVCLHCKNSTARQITAKRASIEDSSDVPASHESLYDDTSEFDLPSPDEFARSMGMGKGKPFASKIAKKRMTFPVGGRPKGTGKVPPGKMGFMKRSRLSDFNRKRGHKSKMCGIFGVPGVGLQRPTADGKSDEEPGVENRLVLCSAKDKYTLTQDICVMCGALGMDQEGCLISCVQCGQCYHPYCINVKITKVILEKGWRCLDCTICEGCGQRNDEARLILCDDCDVSFHIYCMDPPLDYVPHGNWKCKWCAMCLTCGATDPGFNCNWMNSSTQCGPCASHLNCPSCNEPYGDGELIIQCVQCERWLHGSCDCIKNEDDAEKCAEDGYNCILCRPRDVPPPHLVPPPPAPKPPTPTKSPEVGKSSSFYLDGVYLSEMGNSFIKSLALEHHASRKKRKKLPTVQDKEAGIMATIESVIAGGNSGGATALDDSAKLELVDVKDEPQELYKEGMIWTKEDGPAPEGFTVFTMESGISVLRRKRQRNLQKLGIGGFLVRMRGIRTGQDNDEIDSSVIQSGSATPTELLPPMPVDGDKPKRKPIRRKPKSKLAETFPAYLQEAFFGKDLLETVDCKKEVDSCSSDDEKSVKYKSINLSQDELMAVAAVSSKSEKQAIASIKDSLKDIKSSSMIKEEDDDNTEDLKDVLALPGDLLDAEIVNSIMEDDDELTKNTESLDALDTNLQDANELADTLGSSGNSKETKDELSDILGPHFNLESISNINSKDVEDIFKGVLTDESQESQESSNFALQGSNLFSNNTPQQSLAQHSMMTSAVRPKTLPNVSQVNLNSPVGFPPPSPYHSEYSNSPQFSPAFTESPNAWVGVPETPEIDSTNVGVPSTYNQRSSEKMKADESLGNGATISAVLYANMNHPEWKKDFPVWSDRYKQIIKKWRTLSQEQKAPYLQHARDNRSQLRMKKAQQSQTSKESTASTSTPNVTKPVHAVPALVTTLQAVSQQPVGVTTAPTAPITEDQEKMALQQKSAREAEQERQWKQLQAMRQQQTQQQQNIIHEQRVQAIARVQRSISVDPAQQFLSDQQSPLQPSTPQELSPSATPTPSPRQFIGMKSPTFPLPSPVPQTAIRPPTPSHSPHDVSQASTSDGNDHFIQSPSTPKPSFPNRLPTDQFIHQPATPRPQFGIQRPTLQNFGNTMRTDQQDININRQLRDLLQRQQVKKLDEMLPGKVQQQRVWPPIEQQENEASATTGTSAVVATTADTTFRQPLPPSIV

SEQ ID NO: 11091 - protein, 1485 aa, Diabrotica virgifera
MEDSPQEARSNRRSRDTSYKSKAFEKFKQLKKGLKNKYEVDEIDNVYEVVEEKQYVKEVLSRYDDDWIVDDDGGGYVEDGRDIFDDDLDMESIAQASAKSKGTKRKTKNVSENAGKGKIQQMLSSLPSKKKVETKIDDDEMLSEILGEIDSSPSTSGQKPKINEYSALAKKLAAKDYMKNFSQPSKKRVIERKSLPNEEAGEVTHGSVLKEVQSNVGKSTKKPQRNVTEQTVINPFKKVKETPAVKQPQTEAAQEVIEETPLETFDDTLTEDFDDDPMFEELDKTPTPVASCQKVASQTIETDLTQDDFGDDFDVTQIEEFESQPSGDVEEASEKLSDELQAEFETEWENFMNKTVDIDNTTEALLDKSDIPTIDDEGKKIFRFFWWDAYEDPLKQRGTVFLFGRTYCEKSKSFVSCCVAVRNIDRRLFVLPRPYELGPDGQPTDTPVTFKKMYEEFNDRVLKPIGVSTFRSRQTSKKYAFDPNIPQESEYMEVRYPANDPKIDADLIPKKTRTFSKIFGVNTSFLEIFFLERKIKGPCWLDISNPVPVTNPLSWCKFEVNCTKMVDLKVTVTEKPLPPPPLVVTAINIRTCINRKTCGHEIVMASCLTHKKYAVDMQPPDPPFQQHFCVIASPGDQTLPFDIHDALSKYKATKVQKMDSEKGLLNFFVNQFSSIDPDLIVGHDLQGYQINILAERLSKLNTNIFNKLGRLKRSEKKNLEKSLFAGRLVCDIKISAKELIKSRSYDLDALCQVVLKLNENQRIELEPDDVPNMFKTTSDILKLISFTMQDTMYILKIMYNLNVIPLALQITNIAGNVMSKTLMGGRSERNEFLLLHAFSEKGYILPDKEYKKRGDGKQSSKKKPTYAGGLVLDPKVGFYDNLILLMDFNSLYPSIIQEYNICFTTLPISDNDENLFLPDSNLPPGVLPTEIRKLVESRRQVKGMMKKPDISLDLRMQYDIRQMALKLTANSMYGCLGFSNSRFYAKNLAALVTQKGREILTNTRDMIEKMNFNVVYGDTDSIMINTNILEYDQVFKIGVKIKQEVNKLYKQVELDIDGVFKYLLLLKKKKYAAVTLNKDKNGKLVAVKEYKGLDIVRRDWSQISSEAGKYILNQILSDQSADERIEHIREYLRKIREHLTEGKVPTPLLIITKQLTKEPHMYPDKNSLPHVLVALRYNQKSGGHFRAGDTVPYIICEDGTTNSAVQRAYHVDELKSNSELKVDVMYYLGQQIHPVVSRICEPIEGIDSYEIAECLGLDTKNIKRPRQAVNELVGENISRPEVKFRNVDKFKFICYGCKQDNIVEGALVGNAPFLERCRNADCSLKPIDYLPSIQNQLTLSIQSYINKYYENILICEDPACTNETNRLPLKFARKYPICTLCQKGVMFRVYNEQQLYTQLSYFQHIFDLSKLSKKPLMEQEIESGYSSLQDVVEKYLNHSGYSIIDLTDLFSMLDPHKKRETTTIDVNRDVDEDVQYMDEDEEEDV

SEQ ID NO: 11092 - protein, 373 aa, Diabrotica virgifera
MALRTYGDKPISFQLEENGDYYCVGSEVGNYLRLFRGSLYKKYPGMFRRSITNEERKRLIELGLSQHVLASSVSLLRAAEVDDIIEGNDEKYKAVSVHTSEPPMPRESKSKKNLQWVPSLPNSSHLDAVPQATPINRNRVASKKVRTFPLCFDDTDPQVNIENSCQQEILVPIRLDMEIEGQKLRDTFTWNKNESLISPEQFAEVLCDDLDLNPLTFVPAIAQAIRQQLEAFPNEPPSILEENCDQRVIIKLNIHVGNTSLVDQVEWDMSEKQNNAEEFALKLCSELGLGGEFVTAIAYSIRGQLSWHQRTYAFSEAPLPTVEVPFRTPSESDQWAPFLETLTDAEMEKKIRDQDRNTRRIRRLANTTPAVNR

SEQ ID NO: 11093 - protein, 1334 aa, Diabrotica virgifera
MNTTTRVDNTQNPVQKIELTSRSIENALILDNNSPRLLDLMNISSQSGSTASGFADHDYPTISGVSQVINNMTQVKCVNSIPLPTEIVDHFSRVQCHCMMGLFCEINRAWLTVDSDIYVWTYEQNTDLAYFDGISETIVCVGLVKPKMGVFHAFIKYLLILATSVDIVVLGVTFTEKPGDTTEEIQLIPDPVFSLPTDGATVTIISSTNDGRIFYGTKEGKLFEIYYQAESGWFGQRCKKVNLSTSTLSFLVPSFLNAALSEEDGICQISIDESRHILYTLTEKGTIEVCDLGERGNTFSRIAKLGQNTLVNQAMNTVKTLDSQNFRPIVSISAIEATESANLNLVAVSQTGVRFYLTVVSLSNLQPNQRPYTLALAHVRLPPGYSANITVRPRAVHVSHYNDRNLVLISTVNDKDVLWCMSSDMFPFGQTLMEAYSVVNLDGPALAISEVRHPTPLPLPPNQEAPPLVVRQHAEPPKKYVVLTSHSVQIFIKLRPVDILNQILRDSQGLDTEALKTFFTIQKEDQACATCLILASLESDENVEVAEYATRAFFLYGGEPKLVPANIYAGPSVFAPQIISTPAPHNYQTQQYQTAQHFQPNMSQTAPNTTGYEFTGPFVFSAKHNSLYLYLSRILRPIWNMRTVDKLSVDGKVSTTYSTVSSDDCIFILNNLTALHNFLARNTQLSTMSKNQNQFQNSTLNNTSLNMTRMNHTVQDAQMEEKASLNSFKILVSLCCQILGLWRILCEHQFHSLVASLTENEQQILVNTTFKDLFLYRHDICSSLISALVQTYLGDNASVDSISSKLREVCPQMYKTEDMAYSKAIEILKSARTIQNVGEKEELLNSALQICKSIGPNLNIGDVCKEFCNLKGYKAVTELCCHYASKLDPENIAEIYYNAPDSTGDQEGYNYYQNRMEIYRHLLNMLNAMYQELNVTPVPCLNYDLDFSVTQSILTDTPEQSQIGYMMKQVITDILQTPDQIMHINLYDWLISKNMTGDLLTINNDSLETYLKRTAAQNPNDTVALDLLWKFYEHRNDHAAAAKILNSLASRTGVNIPLKERLAYLARSIMCMRSDKIGYAPYLGVFLRDLEDKLEVAKVQEQILEAVMNQQNQIENYGDIVTALNSGLFEISQLYENFAEPFKLLECQLAIIDCAGYTDPALIETIWQQILTDELKKTTGTGTDKVCQLLNKVKHLAKYYAKSMNCFPLDYIIYELEIVNAKLRGDRQLVPTALESMNIPFDSLIAVYNNLNTISGNDHFWQLEENEFHLCEATATLISCFISNQDSYSSIEKRKYISLSQDTVVALLSNLYSKPNTEAIVNKLRNIQARLARI

SEQ ID NO: 11094 - protein, 1421 aa, Diabrotica virgifera
FCLHNRKIYKFFIKNKMTEFTLSYREVIPDQTVFENWKEISLTTGGTQSTLQDIKVAERANGFSYEDSTKHHTRNRFIYWRINYDVLELVEHSLDINLTANRVRYKFTDTPILDGVSIHETYENIIVLVPTVCSIHRLIFPHPDRFHRQDDLLGVHPDLAAPSIFSKASPVDARNPNTFYVFNNPTTATDQLPNLASSYLLPETEEAFFILAYPSTELLLIKQNPDNGQVVCTELKGESLMPRFLSGLAEKFRPRNSDGDTIVSLLFYIVDYETYVLTLTRDAHLKFWSCTKGQCVAVIDVREKTGDGSKDRVQGAILRKAVDGNSTESILAVFLNYSSVGQFHILNPIINGQEITIDRLVTLYSPENDLIDFALQTNRLWSVWRCEDGDSVVYTATLPVSRCASYKSSNWSPIILETLPDANQAPANDGDSDPRQVYLQHIFRPGRFPLHIISKALSIYKRSTILSDAQISASALKQRICLAVDNEIQNTVNGSNVNDDEYLECAEWCWQKFYSCCVQYHIASLKPLGLMLLPSVSGAVFLKKSTFSFLRPLDPLEHMTLCYEDVYRDQFVNFSMLAEDLDTTDDVMNLFKVIVYLEQQMSETFVQAFEKEIFNLHAPDVIMEGLLEKIQSEMDCQFASHILEMMNDVTDLYKGMHKILELLRYENTLASPDNDINPGAMYHFSSLLGTSVVAESLRQQAQIRFQICRNLLLICNILLNEKTLDWGVLEAIRSVCTPEIVVLTQASYVVLWLCGLTTIVNLPFSARESSINRLAPLKLAPVLNLRPLTTCTSLLELFISSTGGQEARKSFARVNCSDEALAHWHISLLPYLNHVRHIIWPITGGTVLAEWLLSSGQHLWLQQYVRLLSNWCEWNSCTRNFLLASAFLSTGEYNKAEDLFETAAKGVLTDGFLQERCLKGNLPSPTGAYIHYYLKVIQLFDLHKAKDSVISIANTALSIVDPEDPLAATLYSIKFKHHLALKHYEFAFDSLNANPDAERKKDNLRDLVKTLLDEKKLDTLLNFTYGSMDEFFTNILLTRARANDAVNNIFYDFLYSYQIKRGPLSHRLAASVMYEQAFRLNHINSVEALEKQVKCYLAAKNVLHLCQPEHAWVVRPADPDDEDEVITIQPLAGSNEEMKVFRLRKQLEVVNIETVEKELIFASAKLKLARFSSSLSPVNITTPVELVTLLNTAGLFKTALDICTTFELSYASIFEVLTKNCVSLTEEENPSAWNWLVENDLQDLPVNRDSAADVVWQFLQDCLEKYEKPCMTTLHYVVCKKIIGMRVYFPHWLVASYKVRNPAEFLRLLHGSGRLEEAIEFTSEYILSAMGYGKEFFGFTQPLAPTSPAFCLPVYAIQRLIDELKIQNSMSLEQPYLKEYENLKTLFTKYLETATRVSNQMCQTKLTSGSLRTNVFSIDAR

SEQ ID NO: 11095 - protein, 968 aa, Diabrotica virgifera
MEMSDENIQVLSKYLQETLNPDPNVRRPAEKFLEGVEVNQNYPLLILNLVHKPEVDMTIRIAGAVAFKNYIKRNWFVEEDGVDRIHESDRAAIKNLIVTLMLSSPESIQKQLSDAISIIGKTDFPLKWPELISQMVEKFSTGDFNVINGVLRTGHSLFKKYRYEFKSQELWIEIKYVLEKLAQPLTDLFVATINLAQTHSNDVNALKVIYSSLVLICKVFYSLNFQDLPEFFEDNIQIWMSNFHTLLTADVKCLQNTDSEEAGIMEQLRSQVCDNIALYAQKYDEEFQQFLPQFVTDVWSLLVSTGLEPKYDLLVSNALQFLSSVAERVQYRHLFEDNNVLSSICEKVIIPNMEFRVSDEELFEDNPEEYTRRDIEGSDIDTRRRAACDLVNTLSQNFEQRIIDIFGQYLQVMLGKYVENAKQYWRSKDAALYLVTSLVSRGATQRHGVTQTSQLVDINQFCQQHILSELERPDVNDLPVLKADAIKYIMTFRSVLPSAIVISTIPQLIRHMTSESAVVHTYAACTLEKILIIKANNQPIVTGAHLEPFTTTLLTNLFGILEKPVSEENEYVMKALMRTFSTLQERVLPFLNVALPKLTEKLQMVAKNPSKPHFNHYLFETFSLAIRIVCKANPTAVTAFEDILFPIFQGILQQDIQEFIPYVFQILSLLMESTPQGNNLEPYMQLLPFLLAPVLWDRPANISPLVRLLCAFALQAAPQIVAQDKVSGFLGVFQKLIASKTHDHEGFFLIQSMIQHLPMEALAPYHKRIFSLLFLRLSSSKTTKYVINLIVFFSLYVVKYSANELISTVDDIQAEMFGKVLEKLYIAEIQKVSVAVDRKIVACGVTKLLCESPEIFSGKYQNYWPQLLQALLKFFEMPVDSSMLPDDHFIEVDDTPTYQTTSAKLNFANTVKSDPLQAIAEPRQFLVQSLATLGNSQPGRLPVYISNMDVQVQTILNSYLSKFAVQLV

SEQ ID NO: 11096 - protein, 202 aa, Diabrotica virgifera
MAKVQLCNITVMDNPSPFLNPFQFEITFECIEELREDLEWKMIYVGSAESEDYDQTLDSVFVGPIPEGKHMFVFQADPPNVSRIPENDALGVTVVLLTCSYRSQEFIRVGYFINNEYTDPELKENLPSPPQFDKVTRNILASEPRVTRFKINWEETNPTENNTNSDQSGASAPTTSEAGPSAPVEVPAFNENSNSWATMECS

SEQ ID NO: 11097 - protein, 316 aa, Diabrotica virgifera
MDQMLPSPGFSIPSIGTPLHQPEEDQLILPNALQQQQQQQQQQIATSNSQVPPLAPMGGLTPTLGLGMGHAMSVPQTKYVTGFALPMSSMNAQTPQHTMSPMVNLGGSITTGAGVTPTMAPSTPSPMTPMTPHSADPGIIPQLQNIVSTVNLSCRLDLKKIALHARNAEYNPKRFAAVIMRIREPRTTALIFSSGKMVCTGAKSEEDSRLAARKYARIIQKLGFPAKFLDFKIQNMVGSCDVKFPIRLEGLVLTHSSFSSYEPELFPGLIYRMVKPRIVLLIFVSGKVVLTGAKVRQEIYEAFDNIYPILKSFKKQ

SEQ ID NO: 11098 - protein, 158 aa, Diabrotica virgifera
MAAIRSMSRLLINRSLQTTAKRTYADQMNFTFAAGNQVYYTATSVKQVDVPSFSGSFGILPAHVPTLAVLKPGVVTVYEDGGNVKKIFVSSGTVTINDDSSVQILAEEAHPVENIDVNAARDILTKAQSQLSSASTDEAKAEASIAVEVGEALVKAAE

SEQ ID NO: 11099 - protein, 328 aa, Diabrotica virgifera
MSGDGSDTEQFDTLFLSVAQYHPQGPTQLLDTFVSFLSRKTDFFIGAKEGEWEKLVMDTFRKYEKSSRAKHEEELKEKREQEARKKAAAAKKAEAETVKPAQITELTDEEAERLQAEINAKKNTSDKAESSSNGPEAATTAKKVGEDEDESEKGKILPNSGNGCDLEKYKWTQTLGDIELKIPLKVNFRVKQKDLVVNMTKKHLTCGIKGQPPIIDDDFPHEIKLEESSWVIEDGKDLLFTFEKINKMNWWSQIVKSDPEISTKKINPEPSKLSDLDGETRGMVEKMMYDQRQKEMGLPTSDEQKKQDVINKFMQQHPEMDFSQCKFN

SEQ ID NO: 11100 - protein, 159 aa, Diabrotica virgifera
MQSSSGMVHGYPGGPGLQWSPDKKHSDRERWICIYPAYINNKKTLAQGRKIAKERCVENPTHQEIRDVLVAAGLKVGVENKLYSRERSKEMLYRGRIRIQLKNDDGSLCNDSFPTRDSIMYHLGDMIPKLKSRQNKSSTEAPQQASTGSKGKGKGKGRR

SEQ ID NO: 11101 - protein, 752 aa, Diabrotica virgifera
MDTKHHKMPKVAKVKNKAPAEIQITAEQLLREAKERDLEILPPPPKQKISDPAELADYQLRRRKQFEDNIRKNRTVISNWIKYAQWEESQKEIQRARSIWERALDVDHRNITIWLKYTEMEMRSRQVNHARNLWDRATVLLPRVNQFWYKYTYMEEMLENVPGARAVFERWMDWQPDEQAWQTYINFELRYKEIDRARQIYERFVITHPEVKHWIKYARFEENHGFIHSSRQIYERAVQFYGDDHLDEKLYIAFAKFEENQKEHDRARVIYKYALDHIPKDETKELYKAYTIHEKKYGDRSGIEEVIMSKRKLQYEQEILQNPTNYDAWFDYLRLVEGENDLDITRETYERAIANIPPTKNKQFWRRYIYLWINYAIFEELEAKDYERTRQVYKACLEILPHKIFTFSKIWLLFAQFEIRQKNLTAARKILGMSIGMCPRDKLFRGYIDLEIQLREFDRCRKLYEKFLEFGPDNCITWMKFAELETLLGDIERARGIFELAINQARLDMPELLWKAYIDFEISQDEPDNARQIYERLLERTSHVKVWLSYAKFELNNPTEDELNVRLARRIFERANENLKSFPEKEARVLLLENWREFENNHGDESSKEKVNAKVPRRIKKRQKVVDEDGIEQGWEEVFDYIFPEDEASRPNLKLLAAAKNWKKKAEDGDEAESTNNVVKSSSDRIREKLLASAKNWKKKQDGIKETSAEENTGEDMQEDNIQNLEQETESKDLDNENQDSSNENDSNDDSS

SEQ ID NO: 11102 - protein, 476 aa, Diabrotica virgifera
MGIKFLEVIKPFCSILPEIAKPERKIQFREKVLWTAITLFIFLVCCQIPLFGIMSSDSADPFYWIRVILASNRGTLMELGISPIVTSGLIMQLLAGAKIIEVGDTPKDRALFNGAQKLFGMVITVGQAIVYVMTGMYGDPAEIGAGVCLLIIIQLFVAGLIVLLLDELLQKGYGLGSGISLFIATNICETIIWKAFSPATVNTGRGTEFEGAVIALFHLLTTRQDKIRGLREAFYRQNLPNLMNLLATVLVFAIVIYFQGFRVDLPIKSARYRGQYSSYPIKLFYTSNIPIILQSALVSNLYVISQMLAVKFQGNFLINLLGVWADVGGGGPARSYPIGGLCYYLSPPESVSHILEDPIHAMLYIVFMLGSCAFFSKTWIEVSGSSAKDVAKQLKEQQMVMRGHRDNSMIHELNRYIPTAAAFGGLCIGALSVLADFMGAIGSGTGILLAVTIIYQYFEIFVKEQSEMGGMGALLF

SEQ ID NO: 11103 - protein, 160 aa, Diabrotica virgifera
MSMVTSPSVELSSYRDQHFKGTRAEQDGLLRLSTTLYVGNLSFYTTEEQIYELFSKCGDIRRVVMGLDKYKKTPCGFCFVEYYNRADAENCLRYINGTRLDDRIVRTDWDAGFIEGRQYGRGKTGGQVRDEYRTDYDSGRGGYGKIIQQKIGIETPAFLR

SEQ ID NO: 11104 - protein, 307 aa, Diabrotica virgifera
MAATIGRICGAGLLKPTNLSSVGQLSSYSTTKEWTRGRKALLGSLGLIAGGTGALLFALDQSVKASDLELHPPKNVWSHSGTFNSLDHASVRRGYEVYKQVCAACHSMRFIAYRNLIGVSHTEAEAKAEAEEQMIEDGPDDTGNFFKRPGKLSDYFPSPYPNEEAARAANNGSYPPDLSYIVSARHGGEDYIFALLTGYCDAPAGVVLRDGQYFNPYFPGGAISMAQALYNETIEYSDGTPATASQLAKDVAVFLKWTSEPEHDDRKKMLIKVIGIFSLLIGITYYAKKLKFSSLKSRKIEFRPKSK

SEQ ID NO: 11105 - protein, 573 aa, Diabrotica virgifera
MLALQQYSGSSDEDDTDNNKNKDTSVDITEIPINSEFSTKNKLAICAAPNVLPTGLDGEKNHIHPDSGELTYNPKYDILFAPVVGPANPFKTQQQSVERNILSGHIEKAHVSDFQFENQRRTFTSYGYALDPSISNDGDGHLKVVGSTEEGKNVESVKTVFETSKIRPLDKRKRKRNDNPGDIEGFLGPWGGFVDEQKVSRPTEEEQAELDEITSKKNKKGKPTEDKPIEEKSVLHIKDPVDYQGRSFLHAPQDVGVNLKSDTPPEKCFLPKSHIHTWTGHSKGVAAIRWFPRTAHLFLSASMDCRIKIWEVYNERRCIRTYYGHRQAVRDINFNNSGKLFLSAGYDRYIKLWDTETGQVVSRFTSRKIPYCVKFNPDKNKQHLFVAGTSDKKIICWDTRSGDIVQEYDRHLGAVNSITFVDENRRFVTTSDDKSLRVWEWDIPVDMKYIADPTMHSMPAVTPAPNGKWLACQSMDNKIVIFSAMNRFKINRKKTFTGHMVAGYACSLDYSPDMSYLVSGDADGKVYVWDWKTTKLYKKWKAHDNVCISVLWHPHEASKMISAGWDGVIKFWD

SEQ ID NO: 11106 - protein, 268 aa, Diabrotica virgifera
MVQKKPKKKVGKKVAAAPLAVKKIEQKKEINPLFEKRPRNFGIGQDIQPPRDLSRFVKWPKYIRIQRQKAVLQKRLKVPPPINQFSQTIDKQTATQLFKVLEKYRPETALQKKNRLKAKAEAKVAKKEEAPAKKPNTLKAGTNTVTKLIEQKKAQLVVIAHDVDPIELVLFLPALCRKMGVPYCIVKGKARLGLLVRRKTCSSVALTQVDSGDRSNFNKLLEVIKTNFNDRVDEIRRHWGGGLLGSKSAARIAKLERAKAKELAQKQG

SEQ ID NO: 11107 - protein, 333 aa, Diabrotica virgifera
MATLTKDVTLQENIPTHILLDKHIDFIKEYGQKESTYEYGMTDYLRISGMYWGLTALELMNATPAQSIEEITEFIKNCQDPESGGISACLYHDPHILHTLSAVQILCIYNKLEAINVEGVVKYIASLQLPDGSFTGDKWGEVDTRFSFCAVMTLSLLNKMDAIDVNKAVDFVLQCKNFDGGFGSRPLSESHAGLMYCCVGFLSITNRLDAIDRDTLAWWLCERQLPSGGLNGRPEKLPDVCYSWWVLSSLTMLGRLHWIDANALKNFILACQDTETGGFADRPGDIADPFHTIFGLAALSLLGHDSVKKVNPTYCMPQEVIDRLQLKPQRLEQ

SEQ ID NO: 11108 - protein, 887 aa, Diabrotica virgifera
MHQEAIQLIQVLEKTVSPDKNELEQASSFLEQAAVTNLLEFIKTLSDILRHGGNSPVARMAAGLQLKNQLTSKDSNIKTTYQQRWLAFPEDVRGYIKNNVVCALGTETSRPSSAAQCVAYVAVTELPQGQWPDLIATLVNNVCHANSTEMQKEATLEAIGYICQEIDSDVLVSQSNDILTAIVHGMRASEPSNHVRLAATQALLNSLEFTKANFDQPTERNYIMEVVCEATQSPDSQIRVAALQCLVKIMSLYYQHMEPYMAPALFPITLEAMKSENDAVSLQGIEFWSNVSDEEVDLAIEDTEATEAGRPPTRCSRHYAKGALQYIVPILLQKLTKQEELDDEDDWNPCKAAGVCLMLLATCCEDEIVPHVLPFIKENIKSDNWRFRDASLMAFGSILGGLESTTLRPLVEQAMPTLIDLMYDNSVIVRDTAAWNFGRICEIIPEAAINETFLKPLLESLITGLKAEPRVAANVCWAFSGLVEAAYENADVNEETGTPDTYVLSQYFEFIIQRLLETTDRPDGAQHNLRPAAYEALMEMVKNSPKDCYVTVQKTTMVILDRLHQVLQMETHISSHNDRSQFNDLQSLLCATLQSVLRKVTPEDAPHISDAIMTAMLTMFNSNSCKSGGVQEDAIMAVSTLVEVLGENFIKYMDAFKPFLYLGLKNHQEYQVCVTAVGLTGDIFRALKLKALPYCDEIMTLLLENLRDQSVHRSVKPEILGVFGDIGLSIGSEFKKYLEVVLSTLAQASQAQVDRNDFDMIDYLNDLREGVLEAYTGIIQGLKGDGPTPHPDVLILEPHIPFIVQFITVVAQDTEHSDSIIAAAAGIVGDMCNVFGAPMVQFLDLDPINEMLAQGRRSRVNRTKTLANWAVKELKKLKAVNTAAAAS

SEQ ID NO: 11109 - protein, 500 aa, Diabrotica virgifera
METILEQQRRYHEEKERLIDAMVKEMLHKKTTFREAINSDHRQKYLLDRYMASTERLIDLYDDRDGQRKAEVAALTGPNEFQEFYSRLKLIKDFYRRHPNEISVPMSVEFDEFAKARENPNEDMANFVEFTDEEGYGKYLDLHECYEKYINLKGIEKVDYITYLGMFDQLYDIPKERKSGEYKKYLLCLIEYLTWFVQRIKPLKDLDIDLQEQVEQVLLNWDNGSVPGWPKETGSALTNVGAHLDLSAFSSWEELASLGLDRLKSALMALGLKCGGTLEERAQRLFSTKGKGSLDPSLMTKNNKGKANKEKELLRQRELATLEAQVYRLAEWVSPQRAATKENVQRKQARTDGERDDSENEESEDDSPDEGDDDVPYNPKNLPLGWDGKPIPYWLYKLHGLNISYNCEICGNYVYKGPKAFQRHFAEWRHAHGMRCLGIPNTAHFANVTQIEDALALWEKLKVQKQSERWQPETEEEYEDSQGNVVNRKTYEDLKRQGLL

SEQ ID NO: 11110 - protein, 212 aa, Diabrotica virgifera
MTIGKNNKMVQHINFRVRVTLQDSRTFIGTFKAFDKHMNMILGDCEEFRKIKSKLSKVEREEKRVLGFVLLRGESIVSLTIEGPPPPEEGLPRVPIPGAAPGPGIGRAGGRGMPPGMAGVPVGLQGPVRGVGGPSQQVMTPGGRGQVSAPPQMNQGPPRMGGPPPGMMGPPPGMMGMAPQMGMGRGGPPPMGMRGPPPGMMRGGPPGPPRPF

SEQ ID NO: 11111 - protein, 438 aa, Diabrotica virgifera
MDLNRRIYVRKANQALLLCLLLSQIRKNKSKPNEPNNQTKPKRTMRPRRYWVREIYKQRKSQGAFNNLIREMKEHDIQKYFNYLRMHPCTFQKLFSLVGPALAKTYCVREPISPEERLAITLRYLASGDSMMSISYAFRVAHNTVSKIIKEACDAIWDCLNQDQLLTPSEEAWLNIAEGFGERWQLPHCVGAIDGKHVVMQAPSKSGSTFFNYKGSHSIVLLALCDASYRFTLVDIGAEGRHSDGGIFKNSNMGKLINTNNINFPQPSLLGQGDTPFNFYIVGDEAFPLTTSIMRPYPGHFLPRDKRIFNYRLSRGRRVIENAFGILASRWRIYRRTIIASESTVVAIVKATVCLHNFMMNNGEKLGHEHKYIVASTVDHENEAGELVHGDWRSEHGNNVLPIGRMGSNMYAKNAQTMRQNLLRYFLNEGAIQFQENK

SEQ ID NO: 11112 - protein, 3690 aa, Diabrotica virgifera
EPQGLDQEKMALQQKSAREAEQERQWKQLQAMRQQQTQQQQNIIHEQRVQAIARVQRSISVDPAQQFLSDQQSPLQPSTPQELSPSATPTPSPRQFIGMKSPTFPLPSPVPQTAIRPPTPSHSPHDVSQASTSDGNDHFIQSPSTPKPSFPNRLPTDQFIHQPATPRPQFGIQRPTLQNFGNTMRTDQQDININRQLRDLLQRQQVKKLDEMLPGTSAVVATTADTTFRQPLPPSIVRPRVALSLAGRAGPGTIRVGQLDARMQGLDPRMRLILQQQVGQQRLSAGIQHQFVRFTSTPARPTTLDQYEQLLHRPSPTQIRAPDQQNAPRMTLNQASVIQRPQLVQPTPTTPATSAADSNPSEEGIPDNVTAELEKLEQETGTMVELQGVSEILGGLGDDDDELLAEMGADFNILEYADPELEALTGGKTNILDLELEEEPVKKEKIVSSAENQPTNQSVNVISSPVKPKQEPVETPTPKPEPASLPPPPPPLALPQQQQPAPVQHTPPVAIQQPTQHPPQVQPTMHLTPQQIHQQMVHQVQQAAAQGRPMPPGSKMQTPDGFIGIVMPNNSVQLQIPQNYQQRLLLLQQLQNQKLQMRVGTTTPRVAVVAQSQLPVGLATGPRMVAAPPPPPPPPYPGPPPPYPGNAAQHQQEQPLLLEDLLEQEKREQEKLQNQPSSQEVSSSTGNESESALLSDHDFERLKADVFNTGPVTSLPSTITNQGTTSHTNQPWQQLQNRQIPAPPAQPTMEVTTRVQMFNANLIAAPPLPPENIVTEQDKQTQMMYEQWLNHQNNVLAQQLRYYETEVQKLRKSRKSLNSKQRQLKKSGNQLTDTDAAELQRISGEQAILQKHLESSRKQSRQHGMLIQEYRNKHPAPKQRVEQIQSPLGPPSSSPLQHPSTSQSPMLSPSLSPLTQHNSPLNSPGPLISSSPGSVSVQNILQSPNSMPTNSMSPLQSSSMQASPMQQSPMQPSPRIGTPHSQSEESPGSAQSPSHVCLPPPMPRMTSPQHRRVVTSPVGMTQMRFVSNQVLQQRVRMQSPIQNFQQKPATPSPLNSPTSQTMNVSQQLQLHKLQQQQSMLQQQQSLDGNQGDPNIIHSQRTTQLLQHRNFIRQQVAQQQQIGQPQPLTPQQHQIMLQQQKQLAQQQQQQIAQMNAARLQQQNNPPHSPMPPKSPMINQQIMSPHSMPPSPMQMPPKSPMVSFSSSNQPNPNSPAARSPAFHQGLSQTPTSPMTHQPPSPMPRSPMVNQTQSPHSMRRPPSANSSPAMPDRPLSVENPSPRMSYSIDHLMQDTLHSQSSHNSMQFTDNFTTDMNVQNSIRENMQSGGGNPNNPCNPIPLPPEYPRFRYFKLGLRGGTPMWGFGRGAKRIPTPPNAPTKPEEKMANQDSMMLQKMKKEPHLSKVSILKRKVGAGSGKIGSLVSTDYNDMDDSSSTPPITPPLATTSRGGIPKTLPKKILENQSSKDSVIVMHSPEDKQLDMMDFDDDTNTVLSAEVSLSSAAQNDEDMLEMETLSQQDLAEGLSSPLEPDQIADEYLLFPGNMVVDMSAGEHFSEKEEEEETVDEEFNDENMHIMIRSPTTSDYEYIMQSKGKKYNVGVHDENDEMPESPDQEDLAVPSPEVSDLLTNYDENDVLMGDQSNSTPEESISTKEDFEELIDEGSRKNSITKSEVTTKQINEFHKYAGIFNYSKGVVQATQNQTALNKITGVANKKAPAKISLVAGPIVHNLSTGKVNPEKLIITQNPNILNTSQAAKVTSIILTHNSAVRRNVLNVPKIVSTVSPAITIVNATTSQMASILPSKFTVPVISASAVRQLSNVKVMDKPSSSSLSISTRDNVLPKKIFEDDSVSPDSSNCEDDKSKDSFDEKAKLESPSREIKPLLKSDASSSNTIISRSLEYKTHDQQKKAEHLQVMNIIQKQRVPSPLMPKSASPVIIHNTPELKMTAQVIQETQTRMKMTATTETLDAYDGSVDDTKSVVISIPSPTPSQEQMLDNIAYQALENRRREFDSIEDVLDMIENITAEPPAILEENVPVQNTKRNTTTESKEKDIDKPKPEIANIPVSVSTKSSAVPQLSPLSQPTDLTMNMANASQQLRSLLSSLQTTSTSSPTNVESVVKNFGHKISSSASPTATQPIVASRVIQQAGRQSPVVTTVNTVIVPNLKQKVTVTTASSSRNSPVKTQVVTTQHVPSSAIITSTINYIPNRTIASMQVMAEHLKFSSGSMSITTPSVSTQQAIAKTTIHNESKKPSLTLTAMLQNQPAANMITKSSADTITAASLLGSPISLPKAGLTSLVQAQPTVVVPVITTSMIALQTQPSIVSTVKSAPMKTNADTITAASLLSSSSVNIAKTGITAALLQAQPNPTLSSLSTATPLTQTSNNIITSSTHRVPTSTTNLLHTQLTKVVRSKSVDDIKEIKQEDIKSESMDTGVDDNKFSLISPSGCKMSTIQNPILNKADDSQNVLLKKLLQNTACASTQSPPPTTASTVTTICPAPKLPIRETSFVSSPNVEPPVSQPSVAAVVPTQPLQLEIKKCLPPSRSSSRDDLLSPQTPRSSTNSQDSSLQTPPIIKKEIVSIPQPQPSPIHTPQEVKKEIMDESSQHSEVSDYSRPDVPIKEETEMADIAIEKPVLDKEELKKQKRRMYQQKRRQNQILNKELAGQPKKRPRKNSKIEEDYDTYIDGVLAQLRQLPGITVSEPVLNRNHGIVSLFGSGDMSKLGTKGYSTQFGDLDGKYGYAELPGYSDFYSTKPYGDLDPIPEKPPSSTQRGFYDQEFPLIRFDTDDHKKFDMFCREDTPDSVLSSSSPECVQVDPEGRFMGLRLISDSEGEDEDNEIEREIQQARDRLSPIVPMIKPVPIRLKPVGGVLVKETPSDNKENINTDSLNIMTKIKSESKPLLPTKDSGHVTVTLTLTSSAAEDIMGVLRDLANILQIPAPTSYQIVERTTTPPSQKLGLYRTKGKDGKEGAPIDIQSILNGATKFCKHCDVIILSNLIRRKVSDLPFLAKDSELLSDGEELFFCSSTCYMQFALMHRSPSISEDKAAEIINHLSQKDNETKQKMQMMEPFDNKSIIAQRLSFTNREMKKEYEPMDTNDYYSYLHNNAENKPNRFYDGAYRPMPVSRIYKNIRYKVWSPGCLQPNQKHKIPTDKEIMELLYRMQITVTPPVMPDDTRKCMFCQGVCDGVADGTARLLNFEVDKWVHLNCGLWSDGVYETVNGALMNLENALQTSLTTPCVHCNMLGATIRCFKTRCSSVYHLNCAVKDNCVFFKNKTVYCIAHVPKNEKDNELTTLSVSRRVYVNRDENRQVAAVMHSSDTDDLLRVGSLIFLNVGQLLPHQLQNFHTSNYIYPIGYKIIRFYWSMKSLNKRCKYICSIHEQFGKPEFRVVVQEPPEDDIEFVDPTPKGAWQRILDQIAFLRKENECLQMFPKFTTGEDLFGLTEPAIVRVLESMPGIETLADYKFKYGRNPLLELPLAINPSGSCRTESRSRTQLHWKKHHTQRTTLSTARPIFGPSPSGPTPSTPTFGELSCPYSKQFVHSKSSQYKKMKQEWKNNVYLARSKIQGLGLYAARDLEKHTMVIEYIGEIIRTELAESREKQYEAKNRGIYMFRLDENRVVDATLSGGLARYINHSCNPNCVAETVEVERDVKIIIFSKRRIMRGEELAYDYKFEFEDDQNKISCMCGAPNCRKWMN

SEQ ID NO: 11113 - protein, 688 aa, Diabrotica undecimpunctata
MERSRKRRDRSISNSSEDSNKKKQYSKNSKGKDKYKDTRDKSSDKSKEKRKKSKKKKKRSRSSSDESSSNSDSSDNSVKLLEKLTKERIRLAEERKKQKELIKATETAEEKRMRRLVKKENKERSRKERMGWDNEYLHYTNSDNPFGDGNLLSTFVWSKKLTKEGLKGVSQAEIEAINRTKQEENKRELEKVKKRRLERELERQKRDEETQMLQRSKEAAQFEEWERQEDKFHLEQARLRSHIRIQDGRAKPIDLLAKYISAEEEVDAVEMHEPYTYLNGLHIKDLEDLVEDIKVYKELERGKNLDYWNDITVIVEDELQKLRKLEKQNDFDLGLNRREGIHQSVAGDVTSVFKGKTAVQLAALEKQIERKISSKADGIDIGYWESLLSQLKAHMARARLRDRHQESLRRKLQVLKAEQAINVTAPSESHSSGGEEAPTKDVQEPKPGPSQEPDDKENDEDEPADEEAANSWLNECFDAYEAGGYSPKFLTPDEIEPGTIVVIEEDDLKRLEFARIQVVGKGKTVENVITKEELMLQKEARKGMDADEAQFSVEQALDSQVYLWSDKYRPRKPRYFNRVHTGFEWNKYNQTHYDMDNPPPKIVQGYKFNIFYPDLIDKSSTPEYYLTPCPENKEFAILRFHAGPPYEDIAFKIVNREWEYSYKRGFRCQFHNNIFQLWFHFKRYRYRR

SEQ ID NO: 11114 - protein, 414 aa, Diabrotica undecimpunctata
MDNLETNIMDKSMRSVFVGNIPYEATEEKLKDIFGEVGQVLSFKLVFDRETGKPKGYGFCEYRDQETALSAMRNLNGYEIGGRNLRVDNACTEKSRMEMQNLLNQPIVENPYGEAVQAEKAPEAISKAVASLPPEQMFELMKQMKTTIQNNPTEARQMLLQNPQLAYALLQAQVVMKIIDAATAVSLLHPVNQVPATLMPGDKNVPVQVPISNQYREPPAPVQPPRQEFQPVPAPVIHPSQNQVFAGQDIDLRSIGAVPDLRLRPMGDQDMRQLPPAIQNPLPPTIGESFVRDPRGSQAFAGDPRQARIDPRQKTIVPPPAPLPIPPLNARPVMPPQPQVPVTRPALTPQPVPTPTPATASPNVANAGASDQEKAALIMQVLQLSDEQISMLPPEQRNSILVLKEQIAKSAHTR

SEQ ID NO: 11115 - protein, 392 aa, Diabrotica undecimpunctata; identical to SEQ ID NO: 11003

SEQ ID NO: 11116 - protein, 276 aa, Diabrotica undecimpunctata
MARRYDTRTTIFSPEGRLYQVEYAMEAISHAGTCLGILANDGILLAAERRNTNKLLDEVFISEKIYKLNDDMVCSVAGITSDANVLTNELRLIGQRYLYQYGESIPCEQLVSWLCDVKQAYTQYGGKRPFGVSILYMGWDKHYGYQLYQSDPSGNYSGWKATCIGNNSSAAISSLKQEYKEGQMTLKDAKTLAVKVLAKTLDMAKLTSEKVEMATLTRKNDKTMIKILSGKEVEELISEYEKSEAAVEASKKRAEGISLITFNWFCLGSLSYKSLS

SEQ ID NO: 11117 - protein, 889 aa, Diabrotica undecimpunctata
MGDSKVEPTKVDKTKGNEDKNKNELSEEDKQLQDELNLCVEKLQDNDEKRYLPALQALSNHIQASTTSMTSVPKPLKFMRPHYDTMKTVHEKITDPDTKKVCADIISVLAMTMGEGRECLKYRLLSNLDKIGEWGHEYVRHLAGEIAGEWAETDFIVNTEIREKLILLTKQIVPYNMAHNAEAEACDLLMEIERLDLLEQYVDENIYHRVCLYLTSCVPYVADPENTTLLQTALLLFRKFDQYPQALRLAMQLNDFGLIEEIFVNCPDSDVQKQLAFMLGRQQIYVEIPEHTPEYEDLIEIMANCHLNNHFLNLARELDIMDPKTPEDVYKSHLENSRPPFGGNQVDSARQNLAASFVNGFVNAAFGQDKLLMEDGNKWLYKNKEHGMLSATASLGLILLWDVDGGLTPIDKYLYSSEDHIKSGALLACGIVNCGVRNECDPALALLSDYVLHNTNIMRIGAIVGLGLAYVGSNREAVLSLITPVLSDPKSNMEVIGMAALACGMISAGSGNSHVTTQIMQVLMEKSEIELKDTYARFLPLGLGLCHLGKQESIDTIIAALEVIPDPFRSMATTMVDICAYAGTGNVLKVQHLLHICSEHYDAPETPDKTSKDKDKKETEKEKDKDLSARQAIAVLGIALISMGEDIGSEMAFRTFGHLLRYCEPAIRRAVPLALGLISVSNPKLSILDTLSKFSHDSDAEVAHNAIFAMGLVGAGTNNARLAAMLRQLAQYHAKDPNNLFMVRIAQGLTHLGKGTLTLSPFHSDRQLMSPVAVAGLMATLIGFLDVKNIILGKSHYLLYTLAAAMQPRMLVTFDDELNPLPVPVRVGLAVDVVGQAGKPKTITGFQTHTTPVLLAYGERAELATEEYIALTPIMEGFVILRKNPEFNS

SEQ ID NO: 11118 - protein, 515 aa, Diabrotica undecimpunctata
MTDNEMDSKDEQNPSPEEVKPKIDTSDTDSQPPQVSVTSGGGVIRRNFITTAGTIVETNEEQPPEPTTEEIVNTENSTPQEQSPVEHKIEPTETTTYQELHQTHQREQFTEPKQYTVEMPAESFSGQNFSQDIGYTSNIATVNIEGNEVPITISSEIDQPGDYTSLQTAQYNNGYTDGPQYLAQHQYQNLYVDRGSVGNSPPATLLFKDDPNLAAARYPTNYDVSSSQSQLNLLPNDTYFTTTANWASTSTGSYQQQYSNTINILHQADSTQSYGGPYVNTAWSSSSIEDGRPPSQEVLVKECVNCGASVTPLWRRDGTGHYLCNACGLYHKINGVHRPPIRPSKKPQATGNRRNGVSCANCKTNNTTLWRRNNQGEPVCNACGLYFKLHGVNRPMSMKKDGIQTRKRRPKNSGGNPGPSGQVRIGNIYQYQHAPELEIQQDTYQLPINVYPSPTQGPYRQYAAENLRGLNAQPLQPIIATDDEQTSVITSTSQQARFRVDTEEDDGSNNQPANA

SEQ ID NO: 11119 - protein, 1472 aa, Diabrotica undecimpunctata
MLSCFRICFETRLVDLLRKTAEHYLKEMVQLIFMRLPQFSEDLKVSYIKQLKMKPGALDQTRTKRKKQYSSLKKDKNDTDIKSPQTPQGNLATVAQSSIVDMQGSLQNPENANPVTPNASPKENFKCDVDIIVDSPVSNNEDLKNIDSISSGVEEAVTEPKSLTEEEITEEQSQTTQDYINQRGIRFTPQLQQEANLSPYGLACVRELLRFLISLCNPLDKQNTEIMIHLGLTLLTVAFEISADNIGKYNTLLALVKDDLCRNLFSLMSTRLAIFSLDLQVSFLLFESLRTHLKYQLEHYLKKLIDIILSDSPKVTYEHKEIALDNLLQLWRIPGFHTELYVNYDCDMYCANLYEELTKLLAKHSISSTTGVYHTHLLSLDALMIITEGIENRCYEEKDRLDAGNSELVQQSNDISFYVGKNSRTKISPIMPKKEELAQKKSIKKWLPQGTEYFNKKPKKGIEFLQEHGVLKQDIDLDEIARFLRENPVLNKAMIGEYISNRSNLKILQSFVDTFNFTGVRIDEALRAFLETFRLPGEAPTISLILEHFAETWHKANNEPFADVDSAFTLAYAIIMLNVDQHNENAKKQTTPMSANAFKKNLKGVNGGNDFDEEMLDDIYTTIKNEEIVMPAEQAGLVRENYFWKILLRKGQTKDGMYIHDNSGTYDSELFQIVYGPIVAALSSVYEKAENESVHKKVMQGFERCAFIAANLNMSTNLDMLILGICKFTVFYNQQKQNNIVVQFGMNSKAQLALRTVFFLIHQHGNTMRDGWKHLFDLLLALYSNGLLSKTFVEVEDFIEPSGKLILVYKEAPSAAKQDTGLLSSLYSYMVSAENLSKIPTPEEQNCIDAAKECIKDCNLEQMITDSKFLHEEALFELVKTLIELSRGPDVHESVAYDYNDNVTVFFLELLIKVVIQNRDRVMTVWQNVRDHIYTLVMNASVFDFQFLLERSVIGLLRIAIRLMRNEEMSHIVLQSLRMLLLLKSSTLSRISRQISFGLYELLKTSAQNIHTNTDWTIIFTLLECVGAGAQPPKPVSSAEETELKNKSDGETSDNHEEEGTLSDSEGRKSPKDNTQRSQSPVSVVTSPVGTPNTGGWILVGNEGEIQPVMGRTVPPTQYGLALEKNLGSHDPRSMMKCCESLAFLVRDVAHITPYNFDVCVHCIRTFVEASLHGSNFKRLRDSRSRKKTLDRSRTRKSPTSSPDEEDSDDENIPSGYHQISIQLLDLMHTLHTRTAQIFKWWAEEGGEISQETSLWTQGWCPLLQGIARLCCDTRRPVRMSAITYLQRALLVHDLQTLSGSEWEQCFQRVLFPLLSYLLQSISPKDAISMEETRIRVATVLSKVFLHHLSPLLALPSFFNLWLVVLDFMDKYMHADKSELLYEAIPESLKNMLLVMDSAKVFDGPDGKNILWNATWERIGKFLPNMKDDLFKEIEDQNRKNEEVSNIEIIVNKEEKDVNTDKLTTNDNLITC

SEQ ID NO: 11120 - protein, 205 aa, Diabrotica undecimpunctata
MSILAYNGGAMVAMKGENCVAIAADRRFGIQAQTVATNFRKIFEMGPHLYVGLPGLATDTQTVMEKLRFRKNLYELKENRKISPKVFASMISNMLYEKRFGPFFVEPVVAGLLPDTYEPFICNMDLIGCINQPSDFVVGGTASAQLYGMCEALWEPNLGPEDLFETISQALINAFDRDAISGWGATVYIIEKDKVTIKNLKTRMD

SEQ ID NO: 11121 - protein, 935 aa, Diabrotica undecimpunctata
MDQKPGIDLVISAVSALYNNPNSSEKERASKWLLELQKSVHAWTVADELLHLKTDLESCYFAAQTMRTKIHQSFHELPQEVHTSLRDSLLEHIGQINEATNTVIVTQLCVALADLALQMPSWQNPTLDLINRFSQTNIWPLLEILTVLPEELESRSVRLGENRRIDVLEEMKVCAPTVNEFLKHCSKVYETNWQDHVQFNVKILRCFTSWISVGAISLNDLSDSIVINRAFEILNFKPQNDKQTISAAFHEAATDCICTLLLSLENNNNQLGLENYLFNNIINLDVPYHLSVANEDQGKSMDYCRLFTELAESFLEKIIANSNTKQMHYAIKILDLVLMCVGHHDYEVAEITFNLWYVLSEELYQKNNKEKTELFRPYVERLITALCRHCQMEPDSEGLLEDGDEFKDFRLKVAELIRDVVFIVGSSACFKQMFINIQGPGVTWDSTEAALFVMQAVAKNVIPGESEVVPQVVEAILNVPENTHVAVKYTSVLLLGELCEWIERHPNTLDPVLNFLVCCLPQPGVGAAAAVALQNICASCNDHMPRHVPILLQLLHQADSFAITNTATLGLLRGVASIIGRMPHEELTKSLRELCSMQLNPICQIIEQDVHPVKGANTDPVMWLDRLSAVLRYVNVHIPEGVENPCKPVILEVWPVLSRTFDKYQSDIRIMERCCRAVRFMLRCVAQEVRELLESLVGQIVRIYTLYQHSCFLYVGSILVDEYAIDPICVPGLLDMLQAFLEPTFHVLQEENGLKNHPDTVDDFFRLCARFMQRAPLAFLKCSSLVHILQCALLASSLDHREANMSVMKFFYDLINQGQSGRADPEFNQRQMLVKSILDEYGQQLVSNLIHSCVFYLHSYMLSEVGDVFVQLLDFDREITCKWVAAGLDVLPKNSNGGIMAATPQQLTDIHTTISRSNTSKSVTHALKDLARLYR

SEQ ID NO: 11122 - protein, 501 aa, Diabrotica undecimpunctata
MAQRFPGPVPNQSPGGPPPQRYQQQPPNQGIRQYAQQNFPQRPGYNPPPPNIPSSGGTMIQRPTGAPYSPMRGGIIPPQQGNKRPADNRTQLQQKSNEYSHSTSKKKKKLADKILPQKVRDLVPESQAYMDLLAFERKLDSTIMRKRLDIQEALKRPMKQKRKLRIFISNTFYPAKEPQPEGPDGPCQEGTVASWELRVEGRLLEDPKNDPNKVKRKFSSFFKSLVIELDKELYGPDNHLVEWHRTLTTQETDGFQVKRPGDKNVRCTILLLLDYQPLQFKLDPRLARLLGVHTQTRPVIISALWQYIKTHRLQDAHEREFIVCDKYLEQIFNCTRMKFAEIPQRLNPLLHPPDPIVINHVISVEGGAESKQTACYDIDVEVDDTLKTQMNNFLLSTASQQEIQGLDAKIHETVDTINQLKTNREFFLSFAKDPQQFIHKWIVSQTRDLKTMTDVVGNPEEERRSDFFYQPWAQEAVCRYFYTKVQQKRAELEQALGIRNN

SEQ ID NO: 11123 - protein, 144 aa, Diabrotica undecimpunctata
MPKVRRSKKPPPEGWELIEPTLDELEQKMREAETESHEGKRKNESLWPIFKIHHQKSRYIFDLFYRRKAISRELYDYCLEENIADKNLIAKWKKQGYESLCCLRCIQTRDTNFGTNCICRVPKSKLEEGRIVECVHCGCRGCSG

SEQ ID NO: 11124 - protein, 294 aa, Diabrotica undecimpunctata; identical to SEQ ID NO: 11012

SEQ ID NO: 11125 - protein, 404 aa, Diabrotica undecimpunctata
  misc_feature (14)..(14): Xaa can be any naturally occurring amino acid
MVLKNPQPFNREQXDLSNVEFETSEDVEVIEKFKNMNLKEELLRGIFAYGFEKPSAIQQRAIKPIMKGRDVIAQAQSGTGKTATFSISILQALDLTMRETQVLCLSPTRELAVQIQKVILALGDFMNVQCHACIGGTNLGEDIRKLDYGQHVVSGTPGRVYDMIRRRALRTRSVKMLVLDEADEMLNKGFKEQIYDVYRFLPPSTQVVLISATLPHEILEITSKFMTDPIRILVKRDELTLEGIKQFFVAVEREEWKFDTLCDLYDTLTITQAVIFCNTKRKVDWLTEKMRENNFTVSSMHGDMPQKERDNIMKEFRSGQSRVLITTDVWARGIDVQQVSLVINYDLPNNRELYIHRIGRSGRFGRKGVAINFVKSDDIRILRDIEQYYSTQIDEMPMNVADLI

SEQ ID NO: 11126 - protein, 534 aa, Diabrotica undecimpunctata
MTAPTAGGDTNRGRTVAYKDKSKPADVRTSNINAAKAVCDAIRTSLGPRGMDKMIQAGNGEVTITNDGATILKQINVIHPAAKMLVELSRAQDIEAGDGTTSVVVIAGALLDAAEKLLHRGIHPTAISESFQRAAHLAVDILSDISTPIEITNRELLIKSASTSLNSKVVSQHSSLLGPLAVDAVLKIVEPGREQACNLSDIKVIKQLGGTVEDTELVEGITFPQRSANVSGPKRIEKAKIGFIQFCISPPKTDMDHNVIVSDYAAMDRVLKEERAYILNIVKQIKKAGCNVLLVQKSILRDAVSDLALHFLDKIKCMVIKDIEREDVEFVCKSLGCRPIASLDHFVAENLVTADLVEEVGVAGNRMVKITGAQNAGRTVTLLVRGSNKLVLEEADRSLHDALCVIRCLVRKKALIAGGGAPEIEVALKLAAMANKLDGIDAICTRAYANALEIIPFTLAENAGLNPIQTVTELRNRHAKGETSAGINVRKGAITDILEENVVQPLLVSTSALSLATETVRSILKIDDIVNTFT

SEQ ID NO: 11127 - protein, 440 aa, Diabrotica undecimpunctata
  misc_feature (186)..(186): Xaa can be any naturally occurring amino acid
MEAMDIVIPEKEEGSPSEVKPVLQDVDTEDLYTKYKKLQQQLEFLEVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVQYSDIGGMDMQKQEIREAVELPLTHFELYKQIXSDIGGMDMQKQEIREAVELPLTHFELYKQIGIDPPRGVLMYGPPGCGKTMLAKAVAHHTTAAFIRVVGSEFVQKYLGEGPRMVRDVFRLAKENSPAIIFIDEIDAIATKRFDAQTGADREVQRILLELLNQMDGFDQTTNVKVIMATNRADTLDPALLRPGRLDRKIEFPLPDRRQKRLIFSTITSKMNLSEEVDLEDYVARPDRISGADINAICQEAGMHAVRENRYIVLPKDFEKGYKNNIKKDESEHEFYK

SEQ ID NO: 11128 - protein, 162 aa, Diabrotica undecimpunctata; identical to SEQ ID NO: 11016

SEQ ID NO: 11129 - protein, 309 aa, Diabrotica undecimpunctata
MDDKASCKELDGWIEQLNDCKQLTENQVKTLCDKAKEILSKESNVQEVKCPVTVCGDVHGQFHDLMELFRIGGRSPDTNYLFMGDYVDRGYYSVETVTLLVALKVRYKERITILRGNHESRQITQVYGFYDECLRKYGNANVWKFFTDLFDYLPLTALVDSQIFCLHGGLSPSIDTLDHIRALDRLQEVPHEGPMCDLLWSDPDDRGGWGISPRGAGYTFGQDISETFNHTNGLSLVSRAHQLVMEGYNWCHERNVVTIFSAPNYCYRCGNQAAIMELDDALKYSFLQFDPAPRRGEPHVTRRTPDYFL

SEQ ID NO: 11130 - protein, 255 aa, Diabrotica undecimpunctata
MGISKLLLVFGALFCAIIAIQADNNGMQIFVKTLTGKTITLDVEPSNTIEYAKAKIQDKEGIPPNQQRLIFAGKQLEDDRTFSDYNIQKESTLHLVLRLRGGMQIFVKSLTGKIVTLEVEPSDTIQNVKAKLDDKIGVPPEQQRLIFGGNQLEDGRTLSDYNIQKDSTFNLVLRLRGGMQIFVKSLTGKITTLQVAPSDTIQSIKAKLDDKIGVPPSQQRIIFAGNELEDGRTLSDYNIQNDSTLNWVLRLKGGK

SEQ ID NO: 11131 - protein, 540 aa, Diabrotica undecimpunctata
MMQPQILLLKEGTDSSQGKPQLISNINACQNVTDAVRTTLGPRGMDKLIVQRQGNATISNDGATILKLLDIVHPAAKTLVDIAKSQDAEVGDGTTSVVLLAGEFLKQIKPYVDEGVHPRIIIKAVRRSFQICLEKISEISVKINKSNADEFRSLLEKCAATAMSSKLINQQRSFFSKMVVDAVLLLDDLLPLNMIGIKKVQGGGLEESLLVAGVAFKKTFSYAGFEMQPKVYKDCKIALLNIELELKAERDNAEVRVDNVKEYQKIVDAEWTILYNKLQKIYESGANVVLSKLPIGDVATQYFADRDMFCAGRVQEDDMKRTLKACGGAVMTTVNDINDSVLGKCELFEEKQIGGDRFNFFKGCPNAKTCTLILRGGAEQFLEETERSLHDAIMIVRRTIKNDAVVAGGGAIEMELSKILRDHSRTIAGKEQLLIGAIAKALEIIPRQLCDNAGFDATNILNKLRQKHAQGHCWYGVDINNEDISDNFEACVWEPAIVKINALTAATEATCLILSVDETIKNQKSEQPPQMGGRGMGRPM

SEQ ID NO: 11132 - protein, 1280 aa, Diabrotica undecimpunctata
  misc_feature (3)..(3): Xaa can be any naturally occurring amino acid
  misc_feature (651)..(651): Xaa can be any naturally occurring amino acid
  misc_feature (1260)..(1260): Xaa can be any naturally occurring amino acid
MSXDEQLSNQSHYDFGLRALKSVLISAGNVKRDRIQRIKEGMTQRGETNIDEASIAENLPEQEILIQSVCETMVPKLVAEDIPLLFSLLNDVFPNVQYTRAEMKGLKDEIRKVCSEEYLVCGEGDERGSAWMEKVLQLYQISNLNHGLMMVGPSGSGKSSAWRVLLKALERFEGVEGVAHVIDPKAISKEALYGVLDPNTREWTDGLFTHILRKIIDNVRGEINKRQWIIFDGDVDPEWVENLNSVLDDNKLLTLPNGERLSLPPNVRVMFEVQDLKYATLATVSRCGMVWFSEDVLSTDMIFENYILRLRNIPLEESEDSSFGKKSDKDDMLSPTLQLQVDVVNLLQPYLSPDGLVVRCLEYAMEQEHIMDFTRLRALSSLFSMLNQAVRNVLQYNHMHPDFPLTNDVLEKYVPKCLIYSILWSFAGDAKLKIRSDLGDFIRSVTTVPLPPDNNMPIIDYEVTIEGEWSLWSNKVPQIEIETHKVASPDVVVPTLDTVRHESLLYTWLAEHKPLVLCGPPGSGKTMTLFSALRALPDMEVVGLNFSSATTPELLLKTFDHYCEYRKTPNGVVLSPIQLGKWLVLFCDEINLPDMDNYGTQRVIMFLRQIVEQKGFYRASDQSWVSLERIQFVGACNPPTDPGRKPLSHRXVEQKGFYRASDQSWVSLERIQFVGACNPPTDPGRKPLSHRFLRHVPVIYVDYPGETSLKQIYGTFTRAMLRLAPGLKGYAEPLTNAMVEFYLASQDRFTQDMQPHYVYSPREMTRWVRGICEAIRPLDNLHVEGLVRLWAHEALRLFQDRLVEDTERRWTNENIDAVALKHFPSANCEKALERPILYSNWLSKDYVPVGREQLREYVKARLKVFYEEELDVPLVLFDEVLDHVLRIDRIFRQPQGHLLLIGVSGAGKTTLSRFVAWMNGLSIFQIKVHNKYTAEDFDEDLRSVLRRSGCKHEKIAFILDESNMLDSSFLERMNTLLANGEVPGLFEGDEYTTLMTQCKEGAQREGLMLDSNDELYKWFTQQVMRNLHVVFTMNPSTDGLKDRAATSPALFNRCVLNWFGDWSDGALFQVGKEFTNRLDLEKQSWRCPDFFPAACNHISASPTHREAVINACVYVHQTLHKANSRLVKRGSRTMAITPRHYLDFIHHLVKLYNEKRSDLEEQQLHLNVGLNKIAETVEQVEEMQKSLAVKSQELQAKNEAANAKLRQMVKDQQEAEKKKVQSQEIQQQLAEQTIHIEQKRSEVMADLEQVEPAVIEAQLXTISLNCTMRNAQIWRSSSCI

SEQ ID NO: 11133 - protein, 438 aa, Diabrotica undecimpunctata
VTQPLGDILVFLTGQDEIETCQELLQDKVRRLGSKVKELLILPLYANLPSDMQGKIFEQTPPGARKVVLATNIAETSLTIDNIIYVIDPGFAKQNHFNSRTGMESLMVVPISKASANQRAGRAGRVAAGKCFRLYTAWSYKHELEDNTVPEIQRINLGNAVLMLKALGINDLVHFDFLDPPPHETLVLALEQLYALGALNHHGELTKLGRRMAELPVDPMMAKMILASEKYKCSEEIVTIGAMLSVNGAIFYRPKDKIIHADTARKNFNHLAGDHLSLLNVYNQWRDSDYSLQWCYENFIQYRSMKRARDVREQLVNLMTRVEIEIVSNVSETVDIRKAITSGYFYHIARFSKGGSYKTVKHNQSVTIHPNSALFESLPRWVLYHELVFTSKEFMRQVIEIESKWLLEVAPHYYKQKELEDSTNKKMPKTVGRSTRTD

SEQ ID NO: 11134 - protein, 456 aa, Diabrotica undecimpunctata
MKVEEVKSTVKTQRISAHSHIKGLGLDEAGFAIPSAAGLVGQEQAREAAGIVVDMIKSKKMAGRAVLLAGPPGTGKTAIALAIAQELGNKVPFCPMVGSEVYSSEIKKTEVLMENFRRAIGLRIRETKEVYEGEVSELTPVETENPAGGYGKTVSHVIIGLRTAKGSKQLKLDPSIYEALQKEKVEVGDVIYIEATSGAVKRQGRSDAYATEFDLEAEEYVPLPKGDVHKKKEVIQDVTLHDLDAANAKPQGGQDVLSMMGQLLKPKKTEITDKLRKEINKIVDKYIDQGIAELVPGVLFIDEVHMLDIETFTYLHRALESAIAPIVIFATNRGRCLIRGTDDVFSPHGIPLDLLDRLLIIRTIPYGRSDMEQILKLRATTEGLEIDHEAITSLGEIGAKATLRYAVQLLTPAHLTAKINGRNNILQSDIEEVGSLFLDAKASAKVLSENKEKFMT

SEQ ID NO: 11135 - protein, 732 aa, Diabrotica undecimpunctata
MTSIIKLQALSGAKDESPPCYILQIDEVRILLDCGWDEKFDMEFIKEIKRHVHNIDAVLLSYPDIYHLGALPYVVGKLGLNCPIYATIPVYKMGQMFMYDLYQSQYNMKEFCIFSLDDVDATFEKIIQLKYNQNVPLKGKGYGLTITPLPAGHMIGGTIWKIMKMEEDIIYCNDFNHKKERHLNGCELDRLQKPSLLITDAFNATYQQARRRARDEKLMTNILQTLRNNGNVLIAVDTAGRVLELAHMLDQLWRNKESGLLAYSLALLNNVSYNVIEFAKSQIEWMSDKLMRSFEGARNNPFQFKHLQWCHSLAELSKVPSPKVVLASSPDLESGFSRELFLQWCSNSNNSIILTTRTSPGTLARDLIDNGAERNIDLTVERRVKLEGVELEEYEKRQRARGHNVEKEDADSDSDSDIEMSVITKGRHDIVIKQEGKINAGFFKVTKKMYPMYPFHEEKIKSDEYGEIIKPENYKLADVTGEGEDNKENVLIKKEIEEEITEIHEQPTKCIVLQRTVQVNCQVHYIDFEGRSDGESLMKILSQLKPRRVIVVRGTEENTSVIAKHCEGIKARVFTPSRGEIVDATSETHIYQVRLTDALVSQLRFQKAKEAEVAWITANVVLKESQADAKRVYVDDEPMEVEDVDTRILTLEPVLEGDCHDPVFINELKLSEFKQVLGRQNITSEFSGGVLWCSNGTIAVRRVESGKIMLEGCISEDYYRIKDLLYEQYAIL

SEQ ID NO: 11136 - protein, 761 aa, Diabrotica undecimpunctata
MAPLESTNNNGNEEPGPINPIVGIIYPPPEVRNIVDKTASFVARNGPEFEARIRQNELGNPKFNFLNSGDPYHSYYQHKVKDFREGKGQDPASGLTQAVSKLSVTASAQQKQQEILKQVEQPFIPKETPAEFEFIADPPSISALDLDIVKLTAQFVARNGRAFLTQLMNREQRNLQFDFLRPQHSLFQYFTKLLEQYTKVLIPPKSMHESLRNEANSPKNVLEQVKYRAEWLKYQEQQKAKEEELLERERVAYAQIDWHEFVVVETVDYQPFEIGNFPAPTTPEEVGARILIQERIEEGEDIEMQLESDEEESPVTESGLSSMQDKTNRKTRDDTRIQDMEEESSDEEKGEDDEELVLPPPPPSIQPPLPPIPDKVVVKKYDPKQAVNVSRPTIGDDYLVSPITGEKIPANKVQEHMRIGLLDPRWVEQRDKQITDKMNQETVYAAGSAIDASLKLLAERRTDIFGVGDEETAIGKKIGEEDVRKDEKVTWDGHTSSVEAATRAARANITLEEQIHQIHKVKGLLPDEEKEKIGPKNIGSKSGKINIQSVITTKPPTALPPKPPVSLIQTQATASLISVPPQPMLPPQPPIMMMSATSMPPIRPPPIMMTGPPPIPGFPVAPMSSPMGPPMNLPPIKHQADAPHEDEPSNKKMRNEDSLIPEKVFLARHQSQVAIKISIPHMPEKSEWKLTGKMISWTVPLAESVANLKAKLQEETNMPPAKQKLFFDGMFFKDSNSLAYYNVTTGSIIQLQIKERGGRKK

SEQ ID NO: 11137 - protein, 322 aa, Diabrotica undecimpunctata
MPSQELTTNKVIVHPLVLLSVVDHFNRMGKIGNQKRVVGVLLGCWRAKGVLDVSNSFAVPFDEDDKDKSVWFLDHDYLENMYGMFKKVNARERVVGWYHTGPKLHQNDIAINELIRRYCPNSVLVIIDAKPKDLGLPTEAYQAVEEVHDDGSPTSKTFEHVPSEIGAEEAEEVGVEHLLRDIKDTTVGTLSQRITNQLLGLKGLHSQLRDIRDYLVQVCANQLPINHQIIYQLQDIFNLLPDINQDAFNTSFYVKNNDQMLVVYLAALVRSIVALHNLINNKLTNRDAEEGKKEDSKKDSKDKDKDKEKEKDKDAKKDEKKK

SEQ ID NO: 11138 - protein, 551 aa, Diabrotica undecimpunctata
MFGGGRAPILVLSQNTKRESGRKVQLENINAGKQIADVIRTCLGPQAMLKMLMDPMGGIVMTNDGNAILREITVQHPAAKSMIEIARTQDEEVGDGTTSVIVLAGEMLVAAEQFLEQHIHPTIIIRQYRQALEDMIQLLEGPLSIPVDRNDKNALAQVVKGCIGTKFISKWSDLAVNIALDAVNTVLLEENGRTEVDIKRYAKVEKIPGGSIEESKILKGVMLNKDVTHPKMKRYIQNPRIILLDCALEYKKGESQTNVEITGDTDFTKLLELEEEHVKRQCDDIIALKPDVVFTEKGVSDLAQHFLLKAGITAIRRVRKSDNNRIARACGATIVNRTEELQESDVGLGAGLFEIKKIGDEYFCFVVECKNPKACTILLRGASKDILNETERNLQDALQVARNIILSPRLVPGGGAIEMAVAQRLMQKATHGPYRALAHALEIIPKTLTQNCGANTIRTLTALRAKHANHTDVNKPCLWGIDGETGELVEMDKKELWEPLAVKLQTYKTAIETAILLLRIDGIVSGSKKKGGNEPPTPSQMQQQEARGDAE

SEQ ID NO: 11139 - protein, 233 aa, Diabrotica undecimpunctata
MMQTANNVYYPDYSTAPMQRQINPYADNGGSVVAIAGEDFVIIGADTRLSAGFSIYTREQNKLFPLSGTTVLGCAGCWCDTLTLTRILKSRMQMYQQEHNKTMSTTACAQMLSTMLYYKRFFPYYISNILVGLDNEGKGCVYSYDPIGHCEKATYRAGGSAGALLQPLLDNQIGQKNMLKTSGEPLSQEKALATLKDVFISAAERDIYTGDSVLINIITKDGVKEESFQLRRD

SEQ ID NO: 11140 - protein, 298 aa, Diabrotica undecimpunctata
MFQFGFNMFPEIPRPFNMTYKCYSVAMFPGNEREDVERGGKIIMPPSALEQLTRLNINYPMLFKLVNKKTHRTTHCGVLEFVADEGKVYLPLWMMNNLVLTEGDLVQMESVSLPVGTFSKFQPLNPDFLDITNPKAVLENGLRSFACLTTGDVIAVKYNQKAYELCVLETKPGDAISIIECDMNVEFAAPVGYKEPEQVKKEEEEMAIDPADLMPEPSGFVAFRGAGNRLDGKKRKDTSGADSSVAKPTYVRGIPDYDYQIGNLTFIRRMIKQKSNDNTEDSEFKAFSGAGFSLKSRT

SEQ ID NO: 11141 - protein, 370 aa, Diabrotica undecimpunctata
MTTLGSKIINKCHKQMAEIAVNAVLAVADLEQKDVNFELIKVEGKVGGKLEDTTLVKGVVIDKTMSHPQMPKELKDVKLAILTCPFEPPKPKTKHKLDVSSVEDYKELRQYEHDKFKEIVGLVKKAGATLAICQWGFDDEANHLLLQQELPAVRWVGGPEIELIAIATGGRIVPRFEELTPEKLGYAGLVREIAFGTTKDRMLVIEECSNSRAVTILVRGGNQMLVAEAKRSLHDALCVVRSLVQEPRVVYGGGAAEIACSLAVAAQADQLASLEQYAYRAFAEALESIPLALADNSGLSAIHTLGEVKAKQAATGDPALGIDCMNTGNLNMREQHVIESLRSKRQQFLLATQLVKMILKIDDVRQPASG

SEQ ID NO: 11142 - protein, 113 aa, Diabrotica undecimpunctata; identical to SEQ ID NO: 11030

SEQ ID NO: 11143 - protein, 534 aa, Diabrotica undecimpunctata
MVSLNPVRILKQEAEEERAEIARLSSFVGAIAIGDLVRSTLGPKGMDKILVSSGRSAGSVEVTNDGATILKSVGVDNPAAKILVDMSKVQDDEVGDGTTSVTVLASELLKEAEKLVEQKIHPQTIIAGWRKAVDIARKALLDTAKDNSSDLEKFREDLMNIARTTLSSKILSQHKEHFAKLAVDAVLRLKGSGDLQSIQLIKKTGGTLEESFLDEGFLLDKKPGVHQPKRVENAKILIANTPMDTDKIKVFGSHIKVDSMAKIAELESAEKEKMKDKVNKILKHNANVFINRQLIYNYPEQLFADAGVMAIEHADFDGIERLALVTGGEIVSTFDHPELVKLGTCKLIEQIMIGEDILLRFSGVALGEACTIVIRGATQQIIDEADRSIHDALCVLAATVKESRIVYGGGCSETLMSTAVSRAAANTPGKEAVAMEAFARALLQLPTIIADNAGYDSAQLVSELKAAHNSSQSTMGLNMEKGELGDMKTLGITESFVVKRQVLVSASEAAEMILRVDNIIKAAPRRRTEDRGMC

SEQ ID NO: 11144 - protein, 262 aa, Diabrotica undecimpunctata
  misc_feature (138)..(138): Xaa can be any naturally occurring amino acid
  misc_feature (259)..(259): Xaa can be any naturally occurring amino acid
MFRNQYDSDVTVWSPQGRLHQVEYAMEAVNLGSATVGLKSKTHAVLIALKRASSELSAYQKKIINIDDHIGITISGLTADARILSRYMRNECLNYKYSLDTYMPLNRLISILGNKMQTCTQRYDRRPFGVGLLVAGYXRNECLNYKYSLDTYMPLNRLISILGNKMQTCTQRYDRRPFGVGLLVAGYDESGSHIYQTCPSANFYDCKAMSIGARSQSARTYLEKHLDELPSSALEELIKHGLRALRDTLPPEVDLTTKXMSP

SEQ ID NO: 11145 - protein, 849 aa, Diabrotica undecimpunctata
MPIKPGNETENMEITFCDEDLPYEEEILRNPYSVKHWLRYIDHKKTAPNNGVNIIFERALKELPGSYKLWYNYLRTRRNQIKSKCITDPGYEEVNNAFERSLVFMHKMPRIWMDYCTFLTDQCKITRTRKVFDRALRALPVTQHNRIWPLYLKFVQKHDIPETAVRVFRRYMKLCPENAEEFIDYLTGIERLDEAAQLMAKIVNDEGFVSQQGKSKHQLWNELCELISKNPEKVHSLNVDAIIRGGLRRYTDQLGHLWNSLANYYVRSGLFERARDIYEEAIQTVTTVRDFTQVFDAYAQFEELSLSKRMEEVANKSSPTEDDDTELELRLARYEYLMERRLLLLNSVLLRQNPHNVQEWHKRVQLYEGKPVDIINTYTEAVQTVDPKLAVGKLHTLWVDFAKFYETNGQIEDARLIFEKASQVSYVKVDDLATVWCEWAEMEIRNENYDEALRLMHKATVMPSRKVAYHDDTETVQSRLYKSLKVWSMYADLEESFGTFKSCKAIYDKIIDLKIATPQIIINYGIFLEENNYFEEAFRAYEKGISLFKWPNVYDIWNTYLTKFLTRYGGSKLERARDLFEQCLDGCPQQFAKHLYLLYAKLEEEHGMARHAMAVYERSTKAVPEQEMFDVFNIYIKRAAEIYGIPKTRQIYEKAIELLPEDKTREMCLRFADMETKLGEIDRARAIYAHCSQICDPRITAEFWQIWKEFEVRHGNEDTMREMLRIKRSVQAVYNTQVNMMSAQMLSSAGSMSGTVADLAPGVKDGMRLLEAKAVEMAGTSQLAKPGGIMFVRGETQGANKDKVVNPDEIDIDSEESEAEEEEVPVEKQSVPSEVFGSLKKQGEEDDDD

SEQ ID NO: 11146 - protein, 388 aa, Diabrotica undecimpunctata
MANGPIAERNRDATIYVGGLDDKVSESLLWELFVQAGPLVNVHMPKDRVTTMHQGYGFVEFMGEEDADYAIKIMNMIKLYGKPIRVNKASAHQKNLDVGANIFIGNLDPEVDEKLLYDTFSAFGVILQTPKIMRDPDTGNSKGFAFINFASFEASDASIEAMNGQYLCNRPISVSYAFKKDSKGERHGSAAERLLAAQNPLSQADRPHQLFADAPPIGLMPMSMAPPPPPVIMTGMMPPPPPTLSNLPPPPPPVPPPSSFPPGIPPPPLPPSQPPLPPGAPPTMPTAAGGQARPPLPPPPVAPHGLIPPPPTWTGAAPGSLPIPPGPPTPAGSASFGGMFPPPPPPGGRPPPPNWRPPPPPPPGFAGNRPAFPPRGPPPPPPTFDTKI

SEQ ID NO: 11147 - protein, 257 aa, Diabrotica undecimpunctata; identical to SEQ ID NO: 11035

SEQ ID NO: 11148 - protein, 140 aa, Diabrotica undecimpunctata
TREIMARTKQTARKSTGGKAPRKQLATKAARKSAPATGGVKKPHRYRPGTVALREIRRYQKSTELLIRKLPFQRLVREIAQDFKTDLRFQSSAVMALQEASEAYLVGLFEDTNLCAIHAKRVTIMPKDIQLARRIRGERA

SEQ ID NO: 11149 - protein, 530 aa, Diabrotica undecimpunctata
MAISLLNPKAEVARAAQALAVNISAAKGIQDVMKSNLGPKGTVKMLVSGAGDIKITKDGNVLLHEMQIQHPTASLIARASTAQDDMTGDGTTSTVLVIGELLKQADIFIAEGLHPRLLTEGFDKARAKALELLDKMKIPIDANKETLTDICRTSLRTKLHQKLADVLTDVCVDAVLAIKKDDKPVDLHMVELMEMQHKTETDTQLIKGLVLDHGSRHPDMPKSLNNCYILTCNVSMEYEKSEVNSGFFYKTAEEREKLVTAEREFIEQRVKKVIELKRSLCNGTDKTFVVINQKGIDPMSLDMLAKEGIIALRRAKRRNMERLSLACGGVAMNSFDDLQESQLGRAGHVYEHVLGENKYTFVEDCKIPQSVTILIKGPNKHTLTQIKDAVRDGLRAINNAIDDKAVIPGAGAFEVTANKELLAFKDTVKGKARLGVAAYAEALLVLPKTLAVNSGFDAQDTIVKLQEESRLNPDPIGLDLTSGEPINPKDAGIYDNYIVKKQIINSCSVIASNLLLVDEIMRAGMSSLKG

SEQ ID NO: 11150 - protein, 1039 aa, Diabrotica undecimpunctata
MSSGSLADNSIDPPAKKRKLESKIATLEMANNEASGSSTGDIDEGLYSRQLYVLGHDAMRRMANSDVLISGLGGLGVEVAKNVILGGVKSVTLHDEALCTIQDLSSQFYLTEADIGKNRAEACCKQLSELNTYVPTKSYTGPLDEDFILKFSAVVLTTSSREEQLRISEITHEKNIALIIADTKGLFAQVFCDFGKSFTVVDVNGEPLVSAMIADISNDVESVVTCIDDTRHGMEDGDYVTFSEVQGMTELNNCEPIKIKVLGPYTFSIGDTTKFSKYTRGGIVSQVKMPKHLEFKSFKDSLENPEIPITDFSKMDFPGQLHLAFTTLHKFVEKTGRLPKPWNNEDATEFVNLAKSLAAKGDSDGEVNSDLLETFAKVSAGDLNPINATIGGIVAQEVMKACSGKFHPIFQWFYYDAIECLPQDKSEITEELAAPTGSRYDGQVAVFGKEFQNKIASLKYFIVGAGAIGCELLKNFAMMGVGTQGEVTVTDMDLIEKSNLNRQFLFRPHNVQQPKSVTAAKVIKKMNPDINVVAHENRVGPETENVYNDDFFEKLDGVANALDNVDARIYMDRRCVYYRKPLLESGTLGTKGNTQVVAPFLSESYSSSQDPPEKSIPICTLKNFPNAIEHTLQWARDMFEGLFKQNAENASLYITDPDFLDRTVKLPGVQPLEVLESVKAALVDERPKDLNDCIAWARNHWQEQYSNQIRQLLFNFPPDQLTSTGQLFWSGPKRCPEALTFDVNDPLHLDYVIAAANLKAEVYGIPTSRNREQIAEVVKQVNVPEFIPKSGVKIAVTDSQMAMNGNNVDLDRVSQIKEELPSVAELGGLRLTPLEFEKDDDTNFHMDFIVAASNLRAANYKIPPADRHKSKLIAGKIIPAIATTTSVVAGMVCLELYKLARSVTSLAPFKNNFINLALPFFSCSEPIAAQQMEYCGNKWTLWDRFDVQGEMTLSEFLEYFKEKHGLEITMLSQGVCMLYSFFMAKAKAQERFGLSMSEVVRRVSKKKIEPHVKALVFELCCNDSTGEDVEVPYVKYNLC

SEQ ID NO: 11151 - protein, 253 aa, Diabrotica undecimpunctata
RILALVRSKKLNLKHLKHFILDECDKMLELLDMRRDVQEIYRNTPHEKQVMMFSATLSKEIRPVCKKFMQDPMEVYVDDEAKLTLHGLQQHYVKLKENEKNKKLFELLDVLEFNQVVIFVKSVQRCVALAQLLTEQNFPAIGIHRGMDQKERLSRYEQFKDFQKRILVATNLFGRGMDIERVNIVFNYDMPEDSDTYLHRVARAGRFGTKGLAITFVSEEGDAKILNEVQERFDVNITELPDEIDLSSYIEGR

SEQ ID NO: 11152 - protein, 343 aa, Diabrotica undecimpunctata
MNKITNQNRRTIDHIAAKCYFYHSRVAELTDKLDSIRGFLHSRLRTATLRNDFEGQAVLINCLLRNYLHYSLYDQADKLVSKCVFPETASNNEWARFLYYLGRIKAARLEYSVAHKHLVQAMRKAPQNAAIGFRQTVQKLTVVVELLLGDIPERQVFRQSSMRHSLAPYFQLTQAVRMGNLQRFGEVLENFGPQFRQDHTFTLILRLHHNVLKTAIRSIGLSYSRISPQDIAKKLGLDSAEDAEFIVAKAIRDGVIEATLDPQGGFMRSKESTDIYCTKEPQLAFHQRISFCLDLHNQSVKAMRYPPKAYGKELESAEERREREQQDLELAKEMAEEDDDGFP

SEQ ID NO: 11153 - protein, 555 aa, Diabrotica undecimpunctata
MATNHQNLPISSILKSKSEVDDEPKKKSREDWRKAKELEEARKAGTAPAAVDEEGKDINPHIPQYISNAPWYYGTSGPTLKHQRPQEEKQKEYSSIDEWYKRGVDTSKIVTKYRKGACENCGAMTHKKKDCMERPRKVGAKFSGANIAPDEFAQKNLALSFDGKRDRWSGYDPSEHKAVIEEFQKVEEAKRQLKADKLNANESSDDEEKDEDKYVDEVDMPGTKVDSKQRITVRNLRIREDTAKYLRNLDLGSAYYDPKTRSMRENPNPEKDATYSGENFVRFTGDTTNHAKAQLFAWEAYEKGVDVHLLAEPTKLELLKKEYEKKKEEVKSTIQSSVLDKYGGQEHLEAPPKSLLLAQSEVYVEYSRSGKVITGAEKEVIRSKYEEDVYINNHTSVWGSYWRGGQWGYKCCHSFIKNSYCLGEAGKTVNAPVTQDIPTDQDVGEASSTKEAGISDGESEDSSSSNSSEGEKLKKKQRRLKKKEKKAKKKEKKAKEKLKKKQEKEMAPEVDEQIMLDDRKRPYNSMFDVKKPTEEEMEEYYKRRKRDEDPMNNFM

SEQ ID NO: 11154 - protein, 208 aa, Diabrotica undecimpunctata
MGISRDHWHKRRATGGKRKPLRKKRKFELGRPAANTKLGARRIHYVRTRGGNLKYRALRIEKGNFAWGSEGTARKTRIIDVVYNASNNELVRTKTLVKNAIVVIDATPFRQWYENHYILPLGRKKGAKLTTEDEEIFNKKRSKKVQKKYETRQKTAKVEPALEEQFQTGRLLACLASRPGQCGRADGYVLEGKELEFYIRKIKSKKAK

SEQ ID NO: 11155 - protein, 311 aa, Diabrotica undecimpunctata; identical to SEQ ID NO: 11043

SEQ ID NO: 11156 - protein, 404 aa, Diabrotica undecimpunctata; identical to SEQ ID NO: 11044

SEQ ID NO: 11157 - protein, 199 aa, Diabrotica undecimpunctata
MVKIYCLSVLYKGPTTATWLKSGFELQSFSFFQRGSIQEFMSFFCKTIVERTIPASRQSVKEGEYLCHVYVRADNLAGVMITDHEYPSRVSHTLITKVLDEFAARIPAANWPNLEERDVAFPQLNTYLAKYQNPREADAMTKIQEDLDETKIILHNTIQAVLERGEKLDDLVSKSEGLSIQSKAFYKTARKTNSCCNFT

SEQ ID NO: 11158 - protein, 242 aa, Diabrotica undecimpunctata; identical to SEQ ID NO: 11046

SEQ ID NO: 11159 - protein, 391 aa, Diabrotica undecimpunctata
MLIFFSQIVVDAANAVKVTDSKGNSMYPIKAVNVLKAHGKSARESFLVPGYALNCTVASQAMPKKIVNAKIACLDFSLQKAKMKMGVQVLITDPNQLEAIRTRELDITKERIQKILSTGVNVILVSGGIDDLCLKYFVENGAMGVRRVKKADLKRIAKATGATFLTSLSNMEGDESFDSSMVGEAAEVVQDRISDDELIIIKGPKARTAASIILRGPNDFYCDEMERSVHDALCVVKRVLESKSVVVGGGSVEAALSIYLENFATTLSSREQLAIAEFARSLLVIPKTLAVNAAQDATDLVAKLRAYQNSSQTKKDHAHLKYVGLDLMEGTVRDNRKAGVLEPTMSKVKSLKFATEAAITILRIDDMIKLDSEQRGGKNYQQAMDSGELYD

SEQ ID NO: 11160 - protein, 293 aa, Diabrotica undecimpunctata
KVIKVSGYGAIMPQRRCSRIKHFLFKTTVTSANSTMTYSLHLLFKFSVLTLWHNGPVPGNFYNFPGSHTSYSNPITHTQSPVTTSTSVLAITYDKGVLMAGDLVASYGSLARYRNCPRVIKVNQNIILGAGGDYADFQYVKSFIEQKIIDEECIDDGLKMKPKSLYCWLTRVMYQRRSKLDPFWNNLVIGGIQDGVPFLGTVDKLGTAYTDKVICTGYGAHIALPLLRDSLDKNGALNLADAKTLIHKCMEVLFYRDARSFPKYQLGIIDKDDGVSIEGPISVEENWNIAHMT

SEQ ID NO: 11161 - protein, 622 aa, Diabrotica undecimpunctata
MYQLSHLLSEQKSLLSALSTTSILEDTQHLSIERENKSNDKDVEEENKQKLAAILEKVEGCKELLEVPGRKFLYEGDLLEIDPTENTSLKTVHVYLFTDGFMITNRNSNSRGLMKYIYEIMYDLSSLAVVNVRDLGNVKHAFKLLIFPDTRVFQCSSNSNKKEWLDKFDQAKKTRLAQEQQKRESISEKSPSRSASIESPSYNPFDEIEDDVGMVHPEWFLDIPEELDVCVAQRHFEEALSLLQKAKEYINQMTAGNEKHDHVFLDIQRKVEQRQNSLTEVLMKELEVNPDKSLQGGLRAARRAVRLLNQLGRENQSCNLFLKLCSSMLRTQCKRVKREGSTTTYIRNLASVVFTNMCHMSDEFLRAFPDSPTCASAYVVWASNELLLFTGHFIKQVFMPQTSLSTVTECIVLVRTQGERLYSYGLDLCYQLDGALRSSLVKALKDGKDKLIDSIKLRALEDKWIPINLHSKSALGRFLHEHSQMGLNLESYVSGDTWIQLTASTLSFTKMFFQLLNDCMKLKTTELVYTIDETLYNVFDAQLKHNENALRNELNQDQRNFLTKNAEFLLVNVIEMSQKIYNQNVGYECATLQKLQGEYVALKKGVSPTTRNTKTKYSSEFL

SEQ ID NO: 11162 - protein, 883 aa, Diabrotica undecimpunctata
MKDVCQITGKDLNPHSHAPTEREDRDRNPDRPVNSSTSVLRLPVNIDEGEEDSRKRVTRISSPERWEIKQMISSGCIAKSELPDFDEETGLLPKDEDGEADIEIELVEDEAPFLQGHGRALHDLSPVRIVKNPDGSLAQAAMMQSALAKERREQKMIQREQEVDSQPSGKNKSWIDPLPEDESRMMGRGIGLQVQDLPEWKKHVIGGKKSSFGKKTNLTIIEQRQSLPIYKLKEELRKAVTDNQILIVIGETGSGKTTQITQYLAEAGFTSRGKIGCTQPRRVAAMSVAKRVAEEFGCRLGQEVGYTIRFEDCTSPETMIKYMTDGMLLRECLMDLDLKQYSVIMLDEAHERTIHTDVLFGLLKQAVMKREELKLIVTSATLDAVKFSQYFFKAPIFTIPGRTFPVEVLYTKEPETDYLDASLITVMQIHLREPPGDILLFLTGQEEIDTACEILYERMKSLGPDVPELIILPVYSALPSEMQTRIFEPAPPGSRKVVIATNIAETSLTIDGIYYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLSKMLIMSVALQCSDEILTIVSMLSVQNVFYRPKDKQALADQKKAKFNQPEGDHLTLLAVYNSWKNNKFSNAWCYENFVQIRTLKRAQDVRKQLLGIMDRHKLDVVSAERNTVRVQKAICSGFFRNAGKKDPQEGYRALVDSQVVYIHPSSALFNRQPEWVIYHELVQTTKEYMREVTTIDPKWLVEFAPAFFKFSDPTKLSKFKKNQRLEPLYNKYEEPNAWRISRVRRRRN

SEQ ID NO: 11163 - protein, 415 aa, Diabrotica undecimpunctata
MSSKRKSKESIIARVNFPLYTLQMLTSRHVIVGGGGGTSKTGVHNGFEIFEIFHDGTRFAAKEVTRHETGGNVVMNCSVYSDRKYSLMVAGQESDCQLYKLNPKLVEEVENIGNNTHLRQRNTKNKEVTDDNKNVTKELYFDVKAIENVQTDFNGSEPLSRVVKINHDGTLLATGGTDGDVRIWKFPSMQPLFILKAHTKEIDDIDFSRYDNYVITIAKDGLAVLWDCMTGKERTKLTWKQPEGSKYLYKRCRFGVIEGLDKKCALYTISNPIGVAKKQKSYLQQWVPEENMLRRCIEFDESLAALAVRDDGRFVAVGTMFSGSVSILVAFNLQKILTIVGAHSMFVTGLEFLPTQNLNHSISSVVEAAVLSISVDNQLCIHTVPYRKTIPLWIAIALLVLTLFLTFSLCSYLGL

SEQ ID NO: 11164 - protein, 413 aa, Diabrotica undecimpunctata
MAGAMLFERAQSVSSQHEKLLKLSRDEEDDEQNIVNKEQDILNLGEKYKKEGKAKELAELIKATRPFLSLISKAKAAKLVRSLVDYFLDLEAGIGIEVQLCKECIEWAKEERRTFLRQSLEARLIALYFDTGMYSEALQLESTLLKELKKLDDKNLLVEVQLLESKTYHALSNLPKARAALTSARTTANAIYCPPKMQAALDLQSGVLHAADEKDFKTAYSYFYEAFEGFDSVESPKALTALKYMLLSKIMINSPEDVQQIVSGKLAFKYAGQDIEAMKSVAQAAHKRSLADFQQAVKQFKHELEDDVIVRAHLGTLYDNMLEQNLCRIIEPYSRVQVEYVAKTIKLPVLQVEKKLSQMILDAKFHGILDQGEGVLIVFEESAVDKTYEMALETIQSMSKVVDTLYQKAKKLS

SEQ ID NO: 11165 - protein, 587 aa, Diabrotica undecimpunctata
MASKSKKGSTPLASQRPASPLSPTRHSRLQEKHELQNLNDRLAGYIDRVRYLEGENNRLTREIQTTQETVTREVSNIKSMYDHELSDARKLLDETHREKARLEIDVKRLLEENDELKSELAKKNKDLALAENSARIYETRCNELQLKANQAASDAKKAIADAKELEKERDKLRKLLDNHRKQLEEESLARVEVENANQSLREELSFKDQIHQQQLTETRTRRQVEISEIDGRLAEKYEAKLQEALQDLRDQYEGQMANNRGEIELLYEQKIKNLQSANDRHQTSASGALDELRQVRTRIDSLNSRISELENQNAGLAARARDLEKLLENERLRHVEDLAMLERELHRLREEMANQLQEYQDLMDIKVSLDLEIAAYRKLLESEEARLNITPTGSEVHEVTHRSQRSSSQRRTPVRLGAKRKRTLLEESQESSLNDYSVNSSSKGDIEVTDVDPEGHYVKLHNKSNQEVALGGWQVIRRVGDEETTFKFHRSLKLEANGYVTIWSSDLNKDHEPPNNLVMKGQKWVVGDNMVTTILNNNGDEVAISERVKRQLTSSHLRHRELAAGYLSEELHHQQGDPQVDERCRLM

SEQ ID NO: 11166 - protein, 760 aa, Diabrotica undecimpunctata
MDELQLFRGDTVLLKGKRRKETVCIVLSDDTCSDEKIRMNRNVRNNLRVRLSDVVSIQACPDVKYGKRIHVLPIDDTVEGLTGNLFEVYLKPYFLEAYRPIHKDDVFVVRGGMRAVEFKVVETDPAPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSEAALQQIREKMDLIDLEDDQIDAEVLNSLAVTMENFRYAMTKSSPSALRETVVEVPNVTWDDIGGLANVKKELQELVQYPVEHPDKFLKFGMQPSRGVLFYGPPGCGKTLLAKAIANECQANFISVKGPELLTMWFGESEANVRDIFDKARSAAPCVLFFDELDSIAKSRGGNVGDAGGAADRVINQILTEMDGMGAKKNVFIIGATNRPDIIDPAILRPGRLDQLIYIPLPDEKSREAIFKANLRKSPVAKDVDLVYIAKVTHGFSGADLTEICQRACKLAIRQSIETEIRRERERALNPNVAMDLDDDDPVPEITRAHFEEAMRFARRSVSDNDIRKYEMFAQTLQQSRGFGTNFRFPTAAGGPAAPGGTAGDQANFQDDPEDDLYS

SEQ ID NO: 11167 - protein, 274 aa, Diabrotica undecimpunctata
MGDQFDCALDLMRRLPPQQIEKNLSDLIDLVPSLCEDLLSSVDQPLKIAKDKETGKDYLLCDYNRDGDSYRSPWSNTYYPPLEDGSMPSEKLRKLELDANLAFDQYREMYFEGGVSSVYFWDLDHGFAGVILIKKTGDGSKKIKGCWDSLHVVEVQEKSSGRNSHYKMTSTAMLWLQTNKQGSGTMNLGGSLTRQIEQDAAVNDINPHIANIGRMVEDMENKIRNTLNEIYFSKTKDIVNSLRSVQPLTESRQQQALKQDLAAALQRRQNKTEN

SEQ ID NO: 11168 - protein, 1256 aa, Diabrotica undecimpunctata
MERPPRNEPPVEPVNGVVQPPVHPPPESPGRVTNQLQFLQKTVLKAVWKHQFAWPFQQPVDARKLNLPDYHRIIKQPMDLGTIKKRLDNNYYWSGKECIQDFNTMFTNCYVYNKPGEDVVVMAQTLEKVFLTKVADMPKEEFVVESPNKAGAAKGKKGRTSTAGAASAPPTPTTATAGSGGRGRPPATVSSTSATPVATTTGSSGIPLGTQAPATVPGSTATTTIAAASTNNSSLSNQQLNSSSSSIHGSGSSLGNSLDSSSVMPANVIPPAQPAKVKKGVKRKADTTTPATAYDYPPTLESKSAKISTRRESGRQIKKPTRPELDGHPPQPPPLKPKEKLPESLKACNEILLELFSKKHSSYAWPFYQPVDAELLGLHDYHDIIKKPMDFSTVKNKMENREYRTPQDFAADVRLIFSNCYKYNPSDHDVVAMARKLQDVFEVKYAKIPDEPVNRVGAPAVNNIPTKSESSTSGSSSDSSSDTEDSEEERRNKQLKLLEKELTAMQEKMRKLVDESTRKKKEKKKDKVKKKPTSGGSLANASLSTLPNSSSAGLGKPGAGGHGALNKSNNNNSIAADSVDDSIASVVSGADLKMAESHHPQTGTGAHHPPAGKSLNMHHNMTANAGANASAQAKTPKSKGLRGNKPAAATNAAPNKRVKANNKAGAGRKKNAAQPPPMQFDSEDEDNAKPMSYDEKRQLSLDINKLPGDKLGRVVHIIQSREPSLRDSNPDEIEIDFETLKPSTLRELESYVASCLRKKPHKKVAGKSKDEQIAEKKQELEKRLIDVNDKIGNSKKAPKKDEANKVDPTGAGGPSGRLSSSSSSSDSDSSSSSLSSSSSDSSDSEAGGTANRQAKKKANKKSPNPSLGSSTTTTTTTIKVPPPQTTATPAPPSQAAPAITTAATANLTTTVSVPPLTTTTTTIAAPIQPAAVPNVAVPAQTTPVAPAFTPSVTVKPSLQAAPIAPTVPPLIKSIEKLPITTHLPPTVPTITPPTVPQAPKSVALPTPSPDKPKPNIISPIGTFTDPIEQSLASLEHDIKQNDPMDVITASTMMQLPTTLSNPVVSHPHPSLNLNPTINHPILQPSTLSMDLKAPIMGTMAPSNTMLHHGLQQAMETDITIPPPPTNMLHGQNNGFGMKHNFDLTTNNNGLSSMGLPMEMSISSMFDPIPQNINNPMMKNDSQLKMDDRMDTLGGLLNDKKSNPLIQKPMSQSFGFKNDKPDHNVKNASSWSSLAKGKSPQNNIPGGSSKQQVMDSF

SEQ ID NO: 11169 - protein, 407 aa, Diabrotica undecimpunctata
MSLSTARPLVSVYNEKSEEVKGSNISLPAVFKAPIRPDVVNFVHQQVSMNHRQPYSVSDKAGHQTSAESWGTGRAVARIPRVRGGGTHRSGQGAFGNMCRGGRMFAPTKPWRRWHRRVNINQRRYALASAVAASGVPALVMSKGHVIDQIPELPLVVSDKVQEMSKTKQAVQFLRRIKAWADIQKVYKSQRFRAGKGKMRNRRRIQRKGPLVVYYKDQGLRRAFRNIPGIDLISVQKLNLLKLAPGGHVGRFIIWTESAFQRLDKLFGTWKTPSLEKKGYNLPQPKMANTDLSRLLKADEIKAVLRAPQKKVVRRVRRLNPLTNAKAMLKLNPYAAVLKREAILKNQKRQLNREELLAKKRGITLSADNVVIRSRKLQERRRAQILKDKKSKPKKVKKAPAKAAGKK

SEQ ID NO: 11170 - protein, 1821 aa, Diabrotica undecimpunctata
MADFIDSEAEESSEEEELDHRDRKKAQKAKVVDSSDEDDEDDDERLREELKDLIDDNPIEESDAESDASGREKRKKSDDEDLDDRLEDEDYDLLEENLGVKVERRKFKRLRRFEDEESEGEEEHDPEQDREQIAMDIFSDDDDERRSERSHRPAVEQDNYGVGEEEEEGEYSDADDFIVDDDGRPIAEKKKKKKPIFTDAALQEAQETFGVDFDYDEFSKYDEDDYEDEEEEDDEYEEDDVEKRKRPKKTSKKKPTKKSIFEVYEPSELKRGFFTDLDNEIRNTDIPERMQLRDVPITAVPDDSTELDDEAEWIYRQAFCNRTVSNVDSHLSSEAREKLKKTPHTIGKIRKALDFIRNQQLEVPFIAFYRKEYVQPELNINDLWKVYKYDAKWCQLKTRKENLLKLFEKMRSYQTDTVMKDPDAPIPDNLRIMTESDIERLKNVQTAEELNDVHNHFILYYAADLPAMHAAWRIKEKERRRQERKEARLKLIAESEEGAEIPEEPEEIDDDEPETETLKYANRSGSYALCSKGGLGPLAKKFGLTPEQFAENLRDNYQRHEVDQEHIEPVEVAKEFVSPKFSTVEEVLQAAKHMVALQIAREPLVRKCVREIFFERARLSVYPTKKGMKVIDEAHNCYSMKYLKNKPVRDLAGDQFLKLCLAEEENLLTITINDHIQGNTTNNYIDEVKQLYIKDEFSKHVQDWNALRMESVERALTKSVLPDLRSELKRTLITEAKEFVLKACCRKLYNWIKIAPYAIKFPDEDEDDWDTSKGVRSMGVAYVPEHTVSAFTCISAPDGDITDYLRLPNILKRKNSFRTDEKLMKEADLQSLKNFIYLKKPHVIAVGGESREALMIADDIRGVINELIESDQFPQIRVEIIDNELAKVYANSIKGTTDFRDYPELLRQAISLARRMQDPLVEFSQLCNSDEEILSLRFHPLQEQVQKEELLEALCLEFVNRTNEVGVDINLAVQQIHKSSLVQFICGLGPRKGQALLKVLKQTNQRLENRTQLVTFCHMGPKVFINCSGFIKIDTNSLGDSTEAYVEILDGSRVHPETYEWARKMAVDALEYDDDEGANPAGALEEILEAPERLKDLDLDAFAEELERQGFGNKSITLYDIRAELNSRYKDLRQPFRSANPEELFDMLTKETPETFYIGKMVTSTVFGIARKKPKPDQLDQANPVRNDETGLWQCPFCLKNDFPELSDVWNHFDAGACPGQATGVKLRLDNGILGYIYIKNISDKPVANPEERVGIGQLIHCRIIKIDVEKFSVDCTSKSSDLADKNHEWRPQRDPHYDQEREDKDNRTEAEKKKEKQRMTYIKRVIVHPAFHNISYAEAEKCMVNMDQGEVIIRPSSKGADHLTITWKVTDGIYQHIDIKEQGKVNAFSLGKSLWIGNEEFEDLDEIIARHVTPMAAHARDLLYFRYYKDFAGGHKDKAEEYLKDEKKKNASKIHYVISAAKNIPGKFLLSYLPRNKVRHEYVTVTPEGFRFRQQMFDSVGSLFKWFKEHFREPPPGGATPGSTPRLASSRTGYGTATPAFSMNNEAIQRVAQNLPSHVVQALSAATNQTPHYPHTPGYGGNYINTPYTPSGQTPYMTPYHTPHTQQTPRYGHQTPSQHMASSAPQGLNNPFLHPGAVTPSQRTPSYRNHPAQSPMLPTSPVPSPGSQSSYSSHLSHNQRSGSYADSLRFQPPESPRSSVSNRSFHSDRYGGDRYGKGSHGGRYGGSSNEDRYGKGGNENTDWQKAAEAWARSRSTPRSDSRNTPRSVGQRTPRYDSDAERSRMKHLSKSPRSVRSTPRTNTSPHSMSLGDATPLYDESI

SEQ ID NO: 11171 - protein, 816 aa, Diabrotica undecimpunctata
MPHTKEANLSSPERKRRRKSKSKSPERKEKKSSKKKAHNSRDRDSSEEDYNPKDYQRYYGEDRPNSDKYWNKYPRKDKTKIGQRYYDAVPEESVKKGADKNSDEKELSKSVEPVPDKSVIKPRERKTVDMLTSRTGGAYIPPAKLRLLQASITDKTSAAYQRIAWEALKKSVHGYINKINTSNIGIIARELLHENIVRGRGLLCKSIIQAQAASPTFTNVYAALVAVINSKFPSIGELLLKRLVLQFKRGFKQNNKSICISATTFVAHLVNQRVAHEILALEILTLLVETPTDDSVEVAISFLKECGQKLTEVSSRGITAIFEMLRNILHEGQLEKRIQYMIEVMFQIRKDGFKDHAAVVEELDLVEEEDQFTHLIMLDDVKEANAEDILNVFKFDDNYEENEDKYKTLSKEILGSDGESESGSEGSEEESEDENEDEVKDQGTIIDNTETNLISLRRTIYLTIQSSLDFEECAHKLLKMELKPGQEIELCHMFLDCCAEQRTYEKFYGLLAQRFCQINKVYIEPFQQIFKDTYSTTHRLDANRLRNVSKFFAHLLFTDAIGWEVLEIMKLNEEDTNSSSRIFIKILFQELAEYMGLGKLNARLKDETLQAYFSGLFPRDNPKNTRFSINFFTSIGLGGLTDELREHLKNIPKMMEMKLATGKEKESSDSSSSESSSEDSSDDSSEDSSSSEDDKVKNKKKSKKLKEKKSKTNSKSRPRSKEKEHADKPRDKRRKEDRYKSDKNPDRSSSKQYSKEDNDKRRKDYEWMKSRYEDNIKQLKNDKRVFEKSSKRRSRSRDKVKGREERRRRSRERRRS

SEQ ID NO: 11172 - protein, 593 aa, Diabrotica undecimpunctata
MALKNQVGQKIMNEVIKHKPTKKNGPTPGQQAHGVEWRILVVDQLAMRMVSACCKMHDISAEGITLVEDIMKKREPLGTMEAVYLITPSEKSVHALMNDFEPPRQMYRGAHVFFTEVCPEELFNELCKSCAARKIKTLKEINIAFLPYESQVFSLDSPDTFQCSYDPSFSAARNANMERMAEQIATLCATLGEYPHVRYRTDWERNVELAQLIQQKLDAYKADEPTMGEGPEKARSQLLILDRGFDCVSPLLHELTFQAMAYDLLPIENDVYKYEASAGVLKEVLLDENDELWVDLRHQHIAVVSQSVTKNLKKFTDSKRMTQSDKQSMKDLSTMIKKMPQYQKELSKYATHLHLAEDCMKAYQGYIDKLCKVEQDLAMGTDAEGEKIKDHMRNIVPILLDPKITNEYDKMRIIALYAMTKNGITDENLSKLATHAQIKDKQTIANLQLLGVNVINDGGPRKKQYTVPRKERITEQTYQMSRWTPIIKDIMEDCIDDKLDQKHYPYLSGRAQSTGYHAAPSSARYGQWHKDRGQQAVKNVPRLLVFVVGGISFSEIRCAYEVTNAQKNWEVIIGSSHILTPEDFLSNLATLAG

SEQ ID NO: 11173 - protein, 712 aa, Diabrotica undecimpunctata
MMQQYMKELEQEPFDAEEFVERLAWRTLAESKGDGEEHEINPALLHESFVQAIKDLNLLHERQQKKCEKLEVVVREDEATFFQEIYNLLEQNKQAMDTFQELDGKINHVATKVLHLGDQLDSVNGPRSRVVDALKLMIHLTEFLSEESVLSPIFTRPELIDDAADVIQKLYLISQDLPPKFDVAKRKIERKYSDIEKSLIEEFVLAMDNENLNRMKEIATVLSQFKGYSQCVDAYIDHSQMGCLSSKDVFSNFLTLCKYNHEIIVKVFNNPEQVMAKFVLNIFQLKLVEYIDQRLNSKLGTYSYLQVLYELYYKTNQLSNDLSVFNMGNDKNFLSKLTTNIFNKYINDYITMELKGLKDRCSANLQKYYESKGHQKKQIQSGGFQDLRRDLQAVIGTRANINIAQIENYGGETFLSEELAITILQDTKHAFQRCQLLSKPTERASNATQILDRLINSLLVEHVDYAVELGLQAVPVVEGTKTPPALYFFSVVHHSNNIIHLVEKQFMDLLVPLVENTPRNNDCVQKKKFVLEDIERKINTGLDRCLNAISSWVKLYLQTEQKKSDFKPESDDFDTVASPACKNVINYVNSIVKEIKANLDGNNVTAILQELGIRLHRVVYDHMLQFQYNTAGAMVAICDLNDYRHCTKALGPLVIELFDTLHALCNLLLVKPENLQQVCSEDSLVKLDRTILHNFIQLRSDFKVQKQMILKV

SEQ ID NO: 11174 - protein, 270 aa, Diabrotica undecimpunctata
MDFQNRPGGKTGGGGVASWSETNRDRRERLRQLALETIDLQKDPYFMKNHLGSYECKLCLTLHNNEGSYLAHTQGKKHQANLARRAAKEAKDAPTLLQPEKPRVEPKKFVKIGRPGYRVTKQRDAESGQQSLLFQIDYPEISDMILPRHRFMSAYEQKIEPPDRKWQYLLFAAEPYETIAFKVPSREVEKTDSKFWTHWNKDTKQFFLQFAFKNDNKRTVNTVVQRHTIVGAAPPPPMLPVPPPPRPPMFNPIPPPPPIMRTVLPVPPPH

SEQ ID NO: 11175 - protein, 134 aa, Diabrotica undecimpunctata
MSIGVPIKVLHEAEGHVITCETITGEVYRGKLIEAEDNMNCQMTQITVTYRDGRVAQLENVYIRGSKIRFLVLPDMLKNAPMFKKQTKAGTAGRGKSAILRAQARGRGRGQTQPVRGRGNWQQNQQAAPAGRGR

SEQ ID NO: 11176 - protein, 483 aa, Diabrotica undecimpunctata
LRRRLCCHFCRSVRLCCQVINSENLGKKDICFISFHTTSLRSMASTITRTPILRAISARSYSQVLPVSGNPSVEPKTSTLPNKLVVAAVDNDASLTRVSVVFRAGSRNEKADNLGAAHVIRIAAGLSTKNASQFAIIRNIQQVGANLTATSDRETISYTLEGTRSAVEKALPYLAEVATNQEFRPWELSELSNRLILDILTRPLQLRAIDLLHNAAYRSKGLGNSLFIPKSQVGKVSSETLQHYVANNFVAGRAAVVGTGISESLLNQFAASLEIPNGEGSTNPSPYKGGELRSNKGGPLAFVAVGGEGAPLKNTKEALAFAVLQKAVCAGPQIKYGVLDNGVYSKALGGSSDVSACAVNVSYSDSGLFGILLAAPAGSVGKAVQSAVKVLKSGSVTDADVQRGKNQLKTSILLNAESGADVVRDLGTQAVLSGAPHSASALAAAVDSVSTSDVQSALRKAGGKLTLASIGNINDVPYLDELK

SEQ ID NO: 11177 - protein, 110 aa, Diabrotica undecimpunctata
MRRAHAGNYYEPLPQTSNEIEDENDRMTNDLQEKIGVLKSLTIDIGNEVKYQDRLLRDVDDDIDKTGGFLGTTMSRVLRLSKGSHNYLILYLFVFSVIVFFVLYLVIKFR

SEQ ID NO: 11178 - protein, 385 aa, Diabrotica undecimpunctata
MLGRVFNGSGKPIDKGPPILAEDYLDIQGQPINPWSRIYPEEMIQTGITAIDVMNSIARGQKIPIFSAAGLPHNDIAAQICRQAGLVKIPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHSDVSNQLYACYAIGKDVQAMKAVVGEEALTPDDLLYLEFLTKFEKNFITQGNYENRTVFESLDIGWQLLRIFPKEMLKRIPASTLAEFYPRDARH

SEQ ID NO: 11179 - protein, 246 aa, Diabrotica undecimpunctata
  misc_feature (234)..(234): Xaa can be any naturally occurring amino acid
MSRGHAGPRIHVPDELREVLLEFTISYLLEQPGDVISYAAEYFTRLRETRVTSRVYDEAAASQEELVSPDESVMSKDEEPSIRFAGRRKSVFAETYDPEEDDDDDDGAKLVYPKSDEQRQRLATAVKNILLFRSLDKDQMNDVLDAMFERVVKKDELVIKQGDDGDNFYVIQSGTFHVFVAPDPSKEPNHIHTYENSGSFGELALLYNMPRAATVKANSEGSLWAMDRQTFRRXSLRSKRGRCTKR

SEQ ID NO: 11180 - protein, 806 aa, Diabrotica undecimpunctata
MSYMQSNQNRPMSQSYHQGPNDLPMQSSKEQTLLWQQNSYMGDSGIQSGAATQVPSLTGKEEEEMDLFDLDQPYQGFTQEQVDEMNNQLNHTRSQRVRAAMFPETLDEGIEIPSTQFDPNHQTAVQRLAEPSQMLKHAVVNLINYQDDADLATRAIPELIKLLNDEDQVVVSQAAMMVHQLSKKEASRHAIMNSPQMVAALVRAISNSNDLETTKGAVGTLHKLSHHRQGLLAIFKSGGIPALVKLLSSPVESVLVYAITTLHNLLLHQDGSKMAVRLAGGLQKMVALLQRNHVKFLSIVTDCLQILAYGNQESKLIILASQGPIELVRIMRSYDYEKLLWTTSRVLKVLSVCASNKPAIVEAGGMQALAMHLGNPSTRLVQNCLWTLRNLSDAATKVDGLESLLQSLVQVLASSDVNVVTCAAGILSNLTCNNQRNKVTVCQVGGVDALVRTIVSAGDREEITEPAVCALRHLTSRHVESEMAQNAVRLNYGMQIIVKLLNPPSRWPLVKAVIGLIRNLALCPANHAPLREHGAIHHLVQLLMRAFQDTQRQRASVASGGSQPPGTYADGVRMEEIVEGTVGALHILSRESHNRAIIRQQMVVPIFVQLLFNDIENIQRVAAGVLCELAADKEGAEMIEQEGATAPLTELLHSRNEGVATYAAAVLFRMSEDKPQDYKKRLSMELTNSLFREENLWNPDLGMGPDLQDILSPDQAYDNMYAQGPPSVHSSHGGRPYQQQGYDQIPIDMQGLDIGSHGGGNGSTYSAIDAMDVTSGDPDLNFDTIDQLPTPPQDNNHAAAWYDTDL

SEQ ID NO: 11181 - protein, 271 aa, Diabrotica undecimpunctata
MARNAEKAMTTLARWRAAQLGEIDKHKKRRPYLASECKNLHACEKWRMQIIREIAKKVAQIQNAGLGEFRIRDLNDEINKLLREKRHWEDQIKELGGPDYQRVGPRMLDHEGKEVPGNRGYKYFGAAKELPGVRELFEQEPPPPPRKSRAELMKDIDADYYGYMDDDDGILIPLEVKAEKIAVQNTVAEWVSKKEQNLENAEDQTEENIYAVEESEDEDSKETVQQLVDGSQQRFVAHVPVPSQQDIEQALLRRRKLELMEKYGVEEEPKA

SEQ ID NO: 11182 - protein, 215 aa, Diabrotica undecimpunctata; identical to SEQ ID NO: 11070

SEQ ID NO: 11183 - protein, 344 aa, Diabrotica undecimpunctata
  misc_feature (341)..(341): Xaa can be any naturally occurring amino acid
MPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEEGEDAVDDPRKLKPGEIDPNPETKPARPDPKDMDEDELEMLSEARARLANTQGKKAKRKAREKQLEEARRLAALQKRRELRAAGIEVTSRRKKKRGVDYNAEIPFEKRPAIGFYDTSNEVLDPMAPDFSKMRQQHLDGELRSEQEERERKKDKQKLKQRKENDIPQAMLQNQEPAKKRSKLVLPEPQISDQEMHQVVKLGKASEAAREIVTESGVETTDTLLNDYTFNPXIKW

SEQ ID NO: 11184 - protein, 157 aa, Diabrotica undecimpunctata; identical to SEQ ID NO: 11072

SEQ ID NO: 11185 - protein, 416 aa, Diabrotica undecimpunctata
MYGLQRISYRIYIRNGFRHYSQQPAKRNSFIGRLFENFKDELAKNKEMKESLKKFREEAQKLEQSDALKAARQKFESVEKEASKSSEVFKESLGSVKEKLKGVIDEASKSDLAKKAGKFTEEVGKTTHKISETAQEISKTGAFQSISQATKAVKQEIDNTSIEGRVYVSPKILRKRTETSAVVHQKYYEPNTDATGVELHKDSKFYESWQNFKDNNPYVHKVMDWKLKYDESENPVIRASRALTEKVGDIMGGLFQKTELSETLTEICKIDPDFDTKRFLKQCETDIIPNILEAMTRGELEVLKDWCHEGPFNLFAVPIKEAYKKGYKIESKILDIDHVDLVLGKVMEQGPVLIISFTSQQVMAVRDASGGVVEGDPDKVMRVNYVWVLCRDVTEPDPRAAWRLLDLSANSNEQLV

SEQ ID NO: 11186 - protein, 309 aa, Diabrotica undecimpunctata
MSSDSELSDSDIELQQAFADGKLKPGLNTVEEGPKHFTNNVSGLKQKLEEIQLKLPWIERLDCVNAQAPLAPELAAQMLTHEQKRSNELRNNKKLTQFTPNEDPVLNDFKREMMFHRQAQAAILDSIPKLKDMGVLTKRPDDYFAEMAKTDAHMQKIREHLMTKQEQQKRSERVKQLRQQRKEGKMLQVQTKLQRQQEKKDMLAQVKKVRKGMSKDLDFLDGKNKSSARKMAEKRKMKDKKFGFGGKKKGMKRNTRDSAADITEFKNPGKPGKKFNNSGKGVKGGKVSKGGNQRMGKSKRIKMRSKGRK

SEQ ID NO: 11187 - protein, 1240 aa, Diabrotica undecimpunctata
MDELQKLEYLSLVSKVCTELENHLGMNDKDLAEFIIHLSEKNGTFESFKKALIENGAEFSDSFISNLLRIIQHMKPKKNKTKVEADVYQKETLATKFPGLALPNEKQKPLFIDEEAPVGENEDDDIVADLMKQFEADAPSNNQKQTTTKSGSASPIERKRSDRSRSRSGSRPRKRRKSKSRDRDSRKDKRRSRSRDQKKNRRDRSGSRSKRNKERSRSRNRRSRSRDRRSRSRDRRNRSKDRKYKNYSRDKDRRERSNSRGIKRERSTEKKFKSEKDNPEFEEDPTPGKIYNGKVSNIVPFGCFVQLEGLKRRWEGLVHISQLRAEGRVTNVSEVTSRGARVKVKVLTVTGQKVSLSMKDVCQITGKDLNPHSHAPTEREDRDRNPDRPVNSSTSVLRLPVNIDEGEEDSRKRVTRISSPERWEIKQMISSGCIAKSELPDFDEETGLLPKDEDGEADIEIELVEDEAPFLQGHGRALHDLSPVRIVKNPDGSLAQAAMMQSALAKERREQKMIQREQEVDSQPSGKNKSWIDPLPEDESRMMGRGIGLQVQDLPEWKKHVIGGKKSSFGKKTNLTIIEQRQSLPIYKLKEELRKAVTDNQILIVIGETGSGKTTQITQYLAEAGFTSRGKIGCTQPRRVAAMSVAKRVAEEFGCRLGQEVGYTIRFEDCTSPETMIKYMTDGMLLRECLMDLDLKQYSVIMLDEAHERTIHTDVLFGLLKQAVMKREELKLIVTSATLDAVKFSQYFFKAPIFTIPGRTFPVEVLYTKEPETDYLDASLITVMQIHLREPPGDILLFLTGQEEIDTACEILYERMKSLGPDVPELIILPVYSALPSEMQTRIFEPAPPGSRKVVIATNIAETSLTIDGIYYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLSKMLIMSVALQCSDEILTIVSMLSVQNVFYRPKDKQALADQKKAKFNQPEGDHLTLLAVYNSWKNNKFSNAWCYENFVQIRTLKRAQDVRKQLLGIMDRHKLDVVSAERNTVRVQKAICSGFFRNAGKKDPQEGYRALVDSQVVYIHPSSALFNRQPEWVIYHELVQTTKEYMREVTTIDPKWLVEFAPAFFKFSDPTKLSKFKKNQRLEPLYNKYEEPNAWRISRVRRRRN

SEQ ID NO: 11188 - protein, 539 aa, Diabrotica undecimpunctata
MNPGAPNYPMASLYVGDLHSDITEAMLFEKFSTAGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDENGSSKGYGFVHFETEEAANKSIEKVNGMLLNGKKVYVGRFIPRKEREKELGEKAKLFTNVYVKNFGEDLSEEELRNMFEKYGKITSYKIMSKDDGKSKGFGFVAFENPEAAETAVEALNGKELMEGKPLYVGRAQKKAERQQELKRRFEALKMERLNRYQGVNLYVKNLDDTIDDERLRKEFSPFGTITSAKVMMEEGRSKGFGFVCFSSPEEATKAVTEMNGRIVGTKPLYVALAQRKEDRKAHLTSQYMQRMANMRMHQMGQFIQPGASSGYFVPTIPTAQRFYGPAQMAQIRTSPRWPAQTPVRPGAQGGATAYTGMPNTYRAATRPPNQSTTMRSNISVPRPITGQQPQSGVVPSTGRTANFKYTSNMRNPPQSMGGIPGAAAPVQQAVHIQGTHVCRYGR

SEQ ID NO: 11189 - protein, 913 aa, Diabrotica undecimpunctata
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSGLVEDQGFLEQLKELLSDSNPMVVANAVAALSEINESSPTGQPLVELSTNTINKLLTALNECTEWGQVFILDSLSNYTPRDEREAQSICERITPRLAHANAAVVLSAVKVLIKMMEILAGDTDFCNTLSKKLAPPLVTLLSSEPEVQYVALRNINLIVQKKPDILKHEMKVFFVKYNDPIYVKLEKLDIMIRLASQVNIAQVLSELKEYATEVDVDFVRKAVRAIGRCAIKVEPSAERCVATLLDLIQTKVNYVVQEAIVVIKDIFRKYPNKYESIISTLCENLDTLDEPEARASMVWIIGEYAERIDNADELLDSFLEGFGDENAQVQLQLLTAVVKLFLKRPQHTQGLVQHVLSLATQDSDNPDLRDRGFIYWRLLSTDPAAAKEVVLADKPLISEETDLLEPTLLDELICHISSLASVYHKPPTAFVEGRSAGIRKSLPARQGSAEETSSAPEPTVIPNQESLIGDLLSMDLNAPAPPIAQPAVPASNVDLLGGGLDSLLDIGTTPAPPTTTGLLGDIFGIPTAPTMYTPPKTIWLPAEKGKGLEIHGAFSRRAGQMSMDLTFTNKAMQAMSAFAIQFNKNSFGIVPGSPLTVPALQPGQSLEYNLALATTGPVQRMDPLTTLQVAIKNNVDIFYYACQIPIQILFTEDGTLDKRVFLTTWRDIPAANEVQYTVNDVKGNTDGVSSKMTLNNIFTIAKRNVEGQDMLYQSLKLTNNIWVLLELKLQPGLTTATLSLKSRSVEVAPYVFQAYDSILKN

SEQ ID NO: 11190 - protein, 165 aa, Diabrotica undecimpunctata
MPPKFDPTEIKYVYMRCVGGEVGATSSLAPKIGPLGLSPKKVGDDIAKGTADWKGLKITVQLKIQNRQATISVVPSASSLIIRALKEPPRDRKKQKNIKHSGNITFDEIIAIARQMRPRSMAKQLSGTVKEVLGTAQSVGCTIDGKAAHDVIDEVNEGTIEVPDE

SEQ ID NO: 11191 - protein, 364 aa, Diabrotica undecimpunctata
MPEEGKRALILVGGYGTRLRPLTLSRPKPLVEFANKPILLHQIEALVDAGVTEVILAVSYRAKQMEEELTVEATKLGVSIIFSHETEPLGTAGPIALAREHLSKSTKPFFVLNSDIICDFPFKALAEFHKNHGKEGTIVVTKVEEPSKYGVVVYDKDNSIQSFVEKPQEFISNKINAGLYILNPSVINRIELKPTSIEKEVFPYMAADKQLYAFELEGFWMDVGQPKDFLTGMCLYLKHLRQTNEEKLYKGPGAVGNVLVDPTAKIGNNCQIGPNVTIGPGVVIEDGVCIKRSTILKDATISSNSWLESCIVGWKCCVGRWVRMEGSTVLGEDVIVKDETYINGGQVLPHKNIATSVPEPQIIM

SEQ ID NO: 11192 - protein, 298 aa, Diabrotica undecimpunctata
NLSTRKPNLNMASDGDDVISDQEKVKIVSDFILHSPPGEFNEVFNDVRKLLNDDDLLKEGASGAFAQYNKDQLTPVKIENADHLVLITEYNDLGNNRFFDPRSKQSFTYDHLRKEALDYQVYTPDSTSEPWRAALDSEFIQYTRNHYKDGVCSVVGRNQSGVINLTACIEDHQFSPKNYWNGRWRSQWSISLTDDSTAEVRGVLKVQVHYYEEGNVQLVSTKEIKETVPVSSEAQTAKEIIQVIEAAEDLYQTAISENYQNMSDTTFKALRRLLPVTRTKMDWNKIVSYSIGKELKTQ

SEQ ID NO: 11193 - protein, 708 aa, Diabrotica undecimpunctata
MKPVFVYITDIADSVQNIGEYTIVPSQYRTRVNQYLTDIKFGFLQINLTESIKVNTYTTTQTTIELTPVVWSRPIPLGWYFQFQWENQYGKNWPKTLCDDWLRTDRYLKNFAHELAQCPCTVEQALADKGRFMPDFDCDKDSNPICYYNNQALHCVKTGSPTLEGSEQQCCYDKNGFLMLSYDQQWGSSPRRCHNLGKMPYNEATKVPTLSQWFNDMVPKYLCCLWQEEQAVGCETLRFERRPTQDCVAYQAPGVAGVYGDPHFVTFDDVEYTFNGKGEFALVKSVTQTDNLEIQGRFEQMDPNAYGEVRATQLTSVVAKGNNTIAVEVRRRPLDSRWRYRLDVIADNRRLYFDRPSLKFQHFQGVTIYTPTYILNQSEVIIMFDNGAGMEVVDNQGYMSARVFLPWSFINKTIGLFGNWSFNKEDDFTLPDGSRAAIVSNINDMERVYTDFGSKWMLDDVLDPQKGRALFHREFGRTSATYNNKTFKPQFLMTPEDFIPANRTADIQRTYEICPLRMYECYYDYGMTLDRDLAHYTKNYKATIYQYKETTRTKVVSCGVLETPRFGRKSTFLFVPGTKVTYECIQEFVLVGDQRRECQADGTWNIPEYGYTYCLRQQEYSQRQAGLASGIIMAILIPLILLFVYLAYRFLQKKQKEKEAEKLEEQQFMDQQRRAHEAATKKLTEAEYASEDEDSNVTSTGAKETTVY

SEQ ID NO: 11194 - protein, 100 aa, Diabrotica undecimpunctata
MSSSSDSDSTFFSSFLASFFSSAAGAAAGAPPAAGAAPPPTGMELNFSRPCAMSSSTDLPLSSLMTFFTFSPSASTPTDPNIFSRSAALGEAFPPKTANK

SEQ ID NO: 11195 - protein, 907 aa, Diabrotica undecimpunctata
MMTDRFGLKWDPKNLEIRTMSVEKTLEPLVLQVTTLVNTKGPSKKKKGKSKRANALVSTVEKATENFIEKGEQIAYENPDITEEMLAAVDEVKKTGHAMSGAAREFSEDPCSSLKRGNMVRAARNLLSAVTRLLILADMVDVHLLLKSLHVVEDDLEKLKNASSNGELLDNIKAFGQNANELMNQAAKRQQELKDPQLRDDLAAARAVLKKHSTMLLTASKVYVRHPELAAAKANRDYVLKQVCEAVNTINDVAQGRTPQPASGPYDGPGELAAALDDFDDHMVMEPLAYNEVHTRPSLEERLESIISGAALMADSSCTRDERRERIVAECNAVRQALQDLLTEYMTNMGNKDKSESLVRAIDNMGRKTKDLRRQLRKAVVDHVSDSFLETNVPLLVLIKAAQNGNEKEVEEYAVVFTEHSNKLVEVANLVCSMSNNEDGVKMVRYAAAQIDNLCPEVINAARILAARPRSKVAQENMDAFKQSWENQVRLLTEAVDDITTIDDFLAVSENHILEDVNKCVLALQEGDSDTLDRTASGIRGRSNRVCNVVTAEMDNYEPCIYTKRVLEAVKVLNDQVMPKFTQRVQVAVQALGNSPPKEVDENDFIDASRLVYDGVREIRRAVLMNRADEDLDPEDVELDENYLIETRSKSSAHTGEHGVDEYPDISGITTAREAMGKMPEEDKQKILQQVEFFRSEKLKFDREVAKWDDTGNDIIVLAKHMCMIMMEMTDFTRGRGPLKTTMDVINAAKKISEAGTKLDKLTRQIAEQCPESSTKKDLLAYLQRIALYCHQMNITSKVKADVQNISGELIVSGLDSATSLIQAAKNLMNAVVLTVKASYVASTKYPRQGTIASPIVVWKMKAPEKKPLVRPEKPEEVRAKVRKGSQKKVQNPIHALSEFQSPTESV

SEQ ID NO: 11196 - protein, 411 aa, Diabrotica undecimpunctata
MSFSFGATPVPTQKTVASGFTLPSNPIVSSTTGIQSTFGSGDNKDQSKPSLFATPSSQPVSFGLTTKANTAPTTLSFGFATPTTLPFGSSTTITPATTPQFGLSLPKASAPATTSFSLLGSAPATTAAAPTGISFGTATTAATTSVTGLSFGTPIGTATTAATTSASGLSFGLTTASSTSSAAPTLLSSTTTSTTSSVSASGALSSTTSAPTFATSSLPSTGTLTFSQLEDSINKWTMDLEEQGKFFINQAKQLNAWDTLLISNGEKILTLNSSIEKVKQQQQQLDQELDFVLAQQKELEELIVPIEKELLGIPVTDIDRNQMYQFSEIVDSQLKQMSDDLKEVIEHINEANKEEEATNPLSQISRILNAHMNSLQWIDRSTAQISSHLEQIGKMQDSNRRNHSFNNSMNF

SEQ ID NO: 11197 - protein, 193 aa, Diabrotica undecimpunctata; identical to SEQ ID NO: 11085

SEQ ID NO: 11198 - protein, 190 aa, Diabrotica undecimpunctata
MDEINLDLLEKRIEALELKVFPAGDPTTIANKNQTITNILTQVQTFVTTALTCRETITSMLQFYGTLNEYLDPAGGADELEVEAKRHYILQLHPEIKDTLQTHTRILQSLLPYVESENISKVVEMTAQLEEASVSHLNLYGEWRDTMYKMVVALQDFTDIMSSIKVLFSQLDNTLTNLEYSLQPKFVTEE

SEQ ID NO: 11199 - protein, 575 aa, Diabrotica undecimpunctata
MNNTKTQEVYSDLTLFTTPDKFFLEPKNGEELLVIERVTEEISVYKNHRHIIPAASSRKDFCGLLGIIRLLSGPYLVIATQRDIVGYISGCAVWRLVKAELIPFRSSLNLSPEKQADNEVYLSMIEQVLTTPFQYFCYDYDLTHSLQRLRDISPDFWKQSLWERADQRFVWNGFLLSPFKNVISKKFCLPLILGFVSINFCVINGHSLNWIIVTRRSVFRAGTRLFRRGIDKDGNVANFVETEQIVEYQGDHASFVQIRGSIPLFWQQNPDLRLKPPPTMIDMDPQEQHSTCLKHLEELATLYGKVVLVNLIDQKGAEGNMEKSFKEAMSSLSYPSARYEPFDFHSECSKMRWDRLKILIDRLALDQDEMGFFLLLRDGSLSSLQDGVFRTNCIDCLDRTNVVQSMLAHRNLEVVLRKLNILHQNQNLEFQYSFEVLFKNVWADNADIISTQYSGTGALKTDFTRTGKRTKAGVFRDGVNSLTRYYKNNLTDGYRQDAIDLFLGYGKPISPLRVDKSWRYITYPSVLLVAVSMFVASAVFPSEYSTESLLFLLFWGSMVYATLHTIFRYGVEFVD

SEQ ID NO: 11200 - protein, 582 aa, Diabrotica undecimpunctata
MPPTIQQNNQNGTANGVEKRPVKTVEKRSDLICKVKYCNTLPDIPFDLKFIAYPFEPIRFIQYNPTSLERNYKYEVLTEHDLGVSIDLINKDIYAIEPGATLDPADEKLLEEDILTPQDSKRSRHHAKSVSWLRRTEYISTEQTRFQPQTMDKVEAKVGYSIKKSLNNETLYMDRDSQIKAIEKTFEDSKNVIEKHYSKPNVVAVDILPVYPDFSLWKYPCAQVIFDSDPAPVGKQVPAQIEEMSQAMIRGVMDESGEQFVAYFLPTEDTLQKRRDDFVNQIPYQDDEEYEYKMAREYNWNVKSKASKGYEENYFFVARPDGIYYNELETRVRLSKRRVKAGAPPSNTRLIVKHRPMDANEFRMQRYREKQLEPPGEDDEEMEVDEPQEEEATQEEQEQEKGEKSPSRSRSRSNSSNRSRSRSKSRSKSRSKSRSKSKSQSRSRSRSKSRSRSRSRSKSRSKSRSHSKSKSKSKSRSRSKSKSKSRSRSKSQSKSPSRSRSRSRSKSKSRSRSASGSRSPSGSRSRSPSKSKSRSRSRSRSGSKSASRSRSSSKASSKSGSRSRSGSRSGSGSESGSGSESD

SEQ ID NO: 11201 - protein, 389 aa, Diabrotica undecimpunctata
MPIENLEDQGLEKNPDLELAHCKFLLNLPEYRSDKNVHAKITEAIKKDDMAPWYELICKDAGWKLDTNLLSALKAKNAEKIKLLDEAIEDAEKNLGEMEVREAYLRKAEYYSRIGDKDNAVSTFRQTYDKTVSLGHRLDIIFHLIRIGLFFMDHDLITRNIEKAKTLIEEGGDWDRRNRLKVYQGAYCMSVRDFKSAANLFLDTVSTFTSYELMDYKAFVRYTVYTSIISLPRNQLRDKVVKGSEILEVLHSEPFVKDYLFSLYNCQYAEFFTNLAEVEIVLRKDYFLNPHYRFYVREMKILAYTQLLESYRSLTLQYMAEAFGVTVEYIDKELSTFIAAGRLHCKIDRVGGIVETNRPDLKNAQFNSVVKQGDLLLNRVQKLSRVINI

SEQ ID NO: 11202 - protein, 1568 aa, Diabrotica undecimpunctata
  misc_feature (1561)..(1561): Xaa can be any naturally occurring amino acid
MSKAGYHAGCQRPIVTSIPKYGWKCRCCRVCGDCGSRTPGAGLSSRWHAHYTVCDSCYQQRNKGFSCPLCHKAYRAHAHREMVQCSNCKKFVHGTCDAEADVATYHQKKDLNPEYEYVCLHCKNSTARQITAKRASIEDSSDVPASHESLYDDTSEFDLPSPDEFARSMGMGKGKPFASKIAKKRINFPIAGRPKGTGKVPPGKMGFMKRSRLSDFNRKRGHKSKMCGIFGVPGVGLQRPTADGKSDEEPGVENRLVLCSAKDKYTLTQDICVMCGALGMDQEGCLISCVQCGQCYHPYCINVKITKVILEKGWRCLDCTICEGCGQRNDEARLILCDDCDVSFHIYCMDPPLDYVPHGNWKCKWCAMCLNCGATDPGFNCNWMNSSTQCGPCASHLNCPSCNEPYGDGELIIQCVQCERWLHGSCDCIKNEDDAEKCAEDGYNCILCRPRDVPPPHLVPPPPAPKPPTPTKSPEVGKSSSFYLDGVYLSEMGNSFIKSLALEHHGSRKKRKKLPTGGNAGGATALEDSAKLELVDVKDEPQELYKEGMIWTKEDGPAPEGFTVFTMESGISVLRRKRQRNLQKLGIGGFLVRMRGIRTGQDNDEIDSSVIQSGSATPTELLPPMPVDGDKPKRKPIRRKPKSKLAETFPAYLQEAFFGKDLLETVDCKKEVDSCSSDDEKSVKYKSINLSQDELMAVAAVSGKSEKQAIASIKDSLKDIKSSPMIKEEDDDNTEDLKDVLALPGDLLDAEIVNSIMEDDDELTKNTESLEVLDTNLQDDTELTDTLGSSGNSKETKDELSDILGPHFNLESISNINSKDVEDIFKGVLTDESQESQESSNFAIQGSNLFSNNTPQPSLAQHSMMTPAVRPKTLPNVSQVNLNSPVGFPPPSPYHSEYSNSPQFSPAFTESPNAWVGVPETPEIDSTNVGVPSTYNQRSSEKMKADESLGNGATISAVLYANMNHPEWKKDFPVWSDRYKQIIKKWRTLSQEQKAPYLQHARDNRSQLRMKKAQQSQTSKESTASASTPNVTKPVHAVPALVTTLQAVSQQPVGVTTAPTAPITEDQEKMALQQKSAREAEQERQWKQLQAMRQQQTQQQQNIIHEQRVQAIARVQRQISVDPAQQFLSEQQSPLQPSTPQELSPSATPTPSPRQFIGMKSPTFPLPSPVAQTAIRPPTPSHSPHDVSQASTPDGNDHFIQSPSTPKPNFPTRLPTDQFIHQPATPRPQFGIQRPPLQNFGNTMRTDQQDININRQLRDLLQRQQVKKLDELLPGKVQQQRVWPPIEQQENEASATTGTSAVVATTADTTFRQPLPPSIVRPRVALSLAGRAGPGTIRVGQLDARMQGLDPRMRLILQQQVGQQRLSTGIQHQFVRFTSTPARPATLDQYEQLLHRPTATQIRAPDQQNAPRMTLNQASVIQRPQMVQPTQSTPATSAADSNPSEEGIPDNVTAELEKLEQETGTMVELQGVSEILGGLGDDDDELLAEMGADFNILEYADPELEALTGGKTNILDLELEEEPVKKEKIVSSAENQPTNQTVNAISSPVKPKHEEPVETPXNFEPCET

SEQ ID NO: 11203 - protein, 971 aa, Diabrotica undecimpunctata
MEIRYPANDPKIDADLIPKRTRTFSKIFGLNTSFLEIFFLERKIKGPCWLDISNPVPVTNPLSWCKFEVNCAKMVDLQVTVTEKPLPPPPLVVTAINIRTCINRKTCGHEIVMASCLTHKKYAVDMQPPDPPFQQHFCVIATPGDQTLPFDIHDALSKYKATKVQKMDSEKGLLNFFVNQFSSIDPDLIIGHDLQGYQINILAERLSKLNTNIFNKLGRLKRSEKKNLEKSLFAGRLVCDIKISAKELIKSRSYDLDALCQVVLKLNENQRIELEPDDVPKMFKTTSDILKLVSFTMQDTMYILKIMYNLNVIPLALQITNIAGNVMSKTLMGGRSERNEFLLLHAFSEKGYIPPDKEYKKKGDGKQSSKKKPTYAGGLVLDPKVGFYDNLILLMDFNSLYPSIIQEYNICFTTLPVSDSDENLFLPDSNLPPGVLPTEIRKLVESRRQVKGMMKKPDLSADLRMQYDIRQMALKLTANSMYGCLGFSNSRFYAKNLAALVTQKGREILTNTRDMIEKMNFNVVYGDTDSIMINTNILEYDQVFKIGVKIKQEVNKLYKQVELDIDGVFKYLLLLKKKKYAAVTLNKDKSGKLVAVKEYKGLDIVRRDWSQISSEAGKYILNQILSDQSADERIEHIREYLRKIREHLTEGKVPTPLLIITKQLTKEPHMYPDKNSLPHVQVALRYNQKSGGHFRAGDTVPYIICEDGTTNSAVQRAYHVDELKSNSDLKVDIMYYLGQQIHPVVSRICEPIEGIDSYEIAECLGLDTKNIKRPRQAVNELIGENISRPEIKFRNVDKFKFICFGCKQENIVEGALVGNSPFLERCRNSDCSVKPIDYLPFIQNQLALSIQSYINKYYENILICEDPACTNETNHLPLKFARKYPICTLCQKGVMFRVYNEQQLYTQLSYFQHIFDLSKLSKKPLMEHEIESGYSSLQDIVEKYLNHSGYSIIDLTELFSMLDPHKKRENT

SEQ ID NO: 11204 - protein, 371 aa, Diabrotica undecimpunctata
MALRTYGDKPISFQLEENGDYYCVGSEVGNYLRLFRGSLYKKYPGMFRRSITNEERKRLIELGLSQHVLASSVSLLRAAEVDDIIEGNDEKYKAVSVHTSEPPMPRESKSKKNLQWVPSLPNSSHLDAVPQATPINRNRVAAKKVRTFPLCFDDTDPQVNIENSCQQEVLVPIRLDMEIEGQKLRDTFTWNKNESLISPEQFAEVLCDDLDLNPLTFVPAIAQAIRQQLEAFPSEPPSIIEENCDQRVIIKLNIHVGNTSLVDQVEWDMSEKQNNAEEFALKLCSELGLGGEFVTAIAYSIRGQLSWHQRTYAFSEAPLPTVEVPFRTPSESDQWAPFLETLTDAEMEKKIRDQDRNTRRIRRLANTTPGW

SEQ ID NO: 11205 - protein, 1386 aa, Diabrotica undecimpunctata
  misc_feature (727)..(727): Xaa can be any naturally occurring amino acid
MNTTRVDNTQNPVQKIELTSRSIENALILDNNSPRLLDFMNINSQSGSTASGFADHDYPTISGVSQVINNMTQVKCVNSIPLPTEIVDHFSRVQCHCMMGLFCEISRAWLTVDSDIYVWTYEQNTDLAYFDGISETIVCVGLVKPKVGVFHAFIKYLLILATSVDIVVLGVTFTEKPGDTTEEIQLIPDPVFSLPTDGATVTIISSTNDGRIFYGTKEGKLFEIYYQAESGWFGQRCKKVNLSTSTLSFLVPSFLNAALSEEDGICQISIDESRHILYTLTEKGTIEVCDLGEKGNMFSRIAKLGQNTLVNQAMNTVKTLDSQNFRPIVSISAIEATESANLNLVAVSQTGVRFYLTVVSLSNMQPNQRPYTLTLAHVRLPPGYSANITVRPRAVHVSHYSDRNLVLISTVNDKDVLWCMSSDMFPFGQTLMEAYSVVNLDGPALAISEVRHPTPLPLPSNQEAPPLVVRQHAEPPKKYVVLTSHSVQIFIKLRPVDILNQILRDSQGLDTEALKTFFTIQKEDQACATCLILASLESDENVEVAEYATRAFFLYGGEPKLAQANIYAGPSVFAPQIISTPAPHQYQSQQYQTAQHFQSNMSQTLPTVPNTTGYEFTGPFIFSAKHNSLYLYLSRILRPVWNLRTVDKLSVDGKVSTTYSTVSSDDCIFILNNLTALHNFLARNTQLSTVSKNQNQFQNTTLNNTSLNMTRMNHTVQDAQMEEKASXHNFLARNTQLSTVSKNQNQFQNTTLNNTSLNMTRMNHTVQDAQMEEKASLNSFKILVSLCCQILGLWRILCEHQFHSLVASLTENEQQILVNTTFKDLFLYRHDICSSLISALVQTYLGDNASVDSISSKLREVCPQLYKTEDMAYSKAIEILKSARTIQNVGEKEELLNSALQICKSIGPNLNIGDVCKEFCNLKGYKAVTELCCHYASKLDPENIAEIYYNAPDSTGDQEGYNYYQNRMEIYRHLLNMLNSMYQELNVTPVPCLNYDLDFSVTQSILTDTPAQSQIGYMMKQVITDILETPDQIMHITLYDWLISKNMTGDLLTINNDSLETYLKRTAAQNPNDTVALDLLWKFYEHRNDHAAAAKILNSLASRSGINIPLKERLAYLARSIMCMRSDKIGYAPYLGVFLRDLEDKLEVAKVQEQILEAVMNQQNQIENYGDIVAALNSGLFEISQLYENFAEPFKLLECQLAIIDCAGYTDPALIETIWQQILTDELKKTTGTGTDKVCQLLNKVKHLAKNYAKSMNCFPLDYIIYELEIVNAKLRGDRQLVPTALESMNIPFDSLITVYNNLNTISGNDHFWQLEENEFHLSEATATLISCFISNQDSYSSIEKRKYTSLSQDTVVALLSNLYSKPNTEAIVNKLRNIQARLARI

SEQ ID NO: 11206 - protein, 1187 aa, Diabrotica undecimpunctata
MTEFTLSYREVIPDQTVFENWKEISLTTGGTQSTLQDIKVAERANGFAYEDSTKHHTRNRFIYWRINYDVLELVEHSLDINLTANRVRYKFTDTPILDGVSIHETYENIIVLVPTVCSIHRLIFPHPDRFHRQDDLLGVHPDLAAPSIFSKASPVDARNPNTFYVFNNPTTATDQLPNLASSYLLPETEEAFFILAYPSTELLLIKQNPDNGQVICTELKGESLMPRFLSGLAEKFRPRNSDGDTIVSLLFYIVDYETYVLTLTRDAHLKFWSCTKGQCVAVIDVREKTGDSSKDRVQGAILRKAVDGNSTESILAVFLNYASGGQFHILNPIIKGQEITIDRLATLYSPENDLIDFALQTNRLWSVWRCEDGDSVVYTATLPVSRCASYKSSNWSPIILETLPDANQAPANDGDSDPRQVYLQHIFHPGRFPLHIISKALSIYKRSTILSDAQISASALKQRICLAVDNEIQNTLNGSNVNDDEYLECADWCWQKFYSCCVQYHIASLKPLGLMLLPSVSGAVFLKKSTFSFLRPLDPLEHMTLCYEDVYRDQFINFSMLAEDLDTTDDVMNLFKVIVYLEQQMSESFAQAFEKEIFNLRAPDVIMEGLLEKIQSEMDYQFASHILEMMNDVTDLYKAMHKILELLRYENTLASPDNDINPGAMYHFSSLLGTSVVAESLRQQAQIRFQICRNLLLICNILLNEKTLDWGVLEAIRSVCTPEIVVLTQASYVVLWLCGLTTIVNLPFSARESSINRLAPLKLAPVLNLRPVTTCTSLLELFISSTGGQEARKSFARVNCSDEALAHWHISLLPYLNHVRHIIWPITGGTVLAEWLLSSGQHLWLQQYVRLLSNWCEWNSCTRNFLLASAFLSTGEYNKAEDLFETGAKGVSTDAFLQERCLKGILPSPTGAYIHYYLKVIQLFELHKAKDSVISIANTALSIVDPEDPLAATLYSIKFKHHLALKHYELAFDSLNANPDAERKKDNLRDLVKTLLDEKKLDTLLNFTYGSMDEFFTNILLTRARANDAVNNIFYDFLYSYQIKRGPLSHRLAASVMYEQAFRLNHINSVEALEKQVKCYLAAKNVLHLCKPEHAWVVRPADPDEEDEVITIQPLAGSNEEMKVFRLRKQVEVVNIETVKKELIFASAKLKLARFSSSLSPVNITTPVELVTLLNTAGLFKTALDIC

SEQ ID NO: 11207 - protein, 968 aa, Diabrotica undecimpunctata
MEMSDENIQVLSKYLQETLNPDPNVRRPAEKFLEGVEVNQNYPLLILNLVHKPEVDMTIRVAGAVAFKNYIKRNWFVEEDGVDRIHESDRVAIKNLIVTLMLSSPESIQKQLSDAISIIGKTDFPLKWPELISQMVEKFSTGDFNVINGVLRTGHSLFKKYRYEFKSQELWIEIKYVLEKLAQPLTDLFVATINLAHTHSNDVNALKVIYSSLVLICKVFYSLNFQDLPEFFEDNIQIWMSNFHTLLTADVKCLQNTDSEEAGIMEQLRSQVCDNIALYAQKYDEEFQQFLPQFVTDVWSLLVSTGLEPKYDLLVSNALQFLSSVAERVQYRHLFEDNNVLSSICEKVIIPNMEFRVSDEELFEDNPEEYTRRDIEGSDIDTRRRAACDLVNTLSQNFEQRIIDIFGQYLQVMLGKYVENAKQYWRSKDAALYLVTSLVSRGATQKHGVTQTSQLVDINQFCQQHVLSELERPDVNDLPVLKADAIKYIMTFRSVLPNAIVISTIPQLIRHMTSESAVVHTYAACTLEKILIIKANNQPIVTGAHLEAFTTTLLTNLFGILEKPVSEENEYVMKALMRTFSTLQERVLPFLNVALPKLTEKLQLVAKNPSKPHFNHYLFETFSLAIRIVCKANPTAVTAFEDILFPIFQGILQQDIQEFIPYVFQILSLLMESTPQGNNLEPYMQLLPFLLAPVLWDRPANISPLVRLLCAFALQAAPQIVSQDKVSGFLGVFQKLIASKTHDHEGFFLIQSMIQHLPMEALAPYHKRIFSLLFLRLSSSKTTKYVINLIVFFSLYVVKYSANELISTVDDIQAEMFGKVLEKLYVAEIQKVSAAVDRKIVACGVTKLLCESPEIFSGKYQNYWPQLLQALLKFFEMPVDASILPDDHFIEVDDTPTYQTTSAKLNFANTTKSDPLQAIAEPRQFLVQSLAALGNSQPGRLPVYISNMDVQVQTILNSYLSKFAVQLV

SEQ ID NO: 11208 - protein, 202 aa, Diabrotica undecimpunctata
MAKVQLCNITVMDNPSPFLNPFQFEITFECIEELREDLEWKMIYVGSAESEDYDQTLDSVFVGPIPEGKHMFVFQADPPNVSRIPENDALGVTVVLLTCSYRSQEFIRVGYFINNEYTDPELKENLPSPPQFDKVTRNILASEPRVTRFKINWEETNPTENNTNSDQNGASAPSTSEAGPSAPVEVPAFNENSNSWATMECS

SEQ ID NO: 11209 - protein, 316 aa, Diabrotica undecimpunctata
MDQMLPSPGFSIPSIGTPLHQPEEDQLILPNALQQQQQQQQQQIATSSSQVPPLAPMGGLTPTLGLGMGHAMSVPQTKYVTGFALPMSSMNAQTPQHTMSPMVNLGGSITTGAGVTPTMAPSTPSPMTPMTPHSADPGIIPQLQNIVSTVNLSCRLDLKKIALHARNAEYNPKRFAAVIMRIREPRTTALIFSSGKMVCTGAKSEEDSRLAARKYARIIQKLGFPAKFLDFKIQNMVGSCDVKFPIRLEGLVLTHSSFSSYEPELFPGLIYRMVKPRIVLLIFVSGKVVLTGAKVRQEIYEAFDNIYPILKSFKKQ

SEQ ID NO: 11210 - protein, 158 aa, Diabrotica undecimpunctata
MAAIRSMSRLLLNRSLQTTARRTYADQMNFTFAAGNQVYYTATSVKQVDVPSFSGSFGILPAHVPTLAVLKPGVVTVYEDDGKVKKIFVSSGTVTINDDSSVQILAEEAHPVENIDVNAARDILTKAQSQLSSASTDEARAEASIAVEVGEALVKAAE

SEQ ID NO: 11211 - protein, 328 aa, Diabrotica undecimpunctata
MSGDGSDTEQFDTLFLSVAQYHPQGPTQLLDTFVNFLSRKTDFFIGAKEGEWEKLVMDTFKKYEKLSRSKHEEELKEKREQEARKKAAAAKKAEAEVVKPAQITELTDEEAERIQAEINAKLNTSVNAESSSNGSEAAAATKKVEEDEDESEKGKILPNTGNGCDLEKYKWTQTLGDIELKIPLKVNFRVKQKDLVVNMTKKHLTCGIKGQPPIIDDDFPHEIKLEESSWVIEDGKDLLFTFEKVNKMNWWSQIVKSDPEISTKKINPEPSKLSDLDGETRGMVEKMMYDQRQKEMGLPTSDEQKKQDVIKKFMEQHPEMDFTQCKFN

SEQ ID NO: 11212 - protein, 159 aa, Diabrotica undecimpunctata
MQSSSGMVHGYPGGPGLQWSPDKKHSDRERWICIYPAYINNKKTLAQGRKIAKERCVENPTHQEIRDVLVAAGLKVGVENKLYSRERSKEMLYRGRIRIQLKNDDGSLCNDGFPTRESIMYHLGDMIPKLKSRQNKSSGEAPQQASTGTKGKGKGKGRR

SEQ ID NO: 11213 - protein, 752 aa, Diabrotica undecimpunctata
MDTKHHKMPKVAKVKNKAPAEIQITAEQLLREAKERDLEILPPPPKQKISDPAELADYQLRRRKQFEDNIRKNRTVISNWIKYAQWEESQKEIQRARSIWERALDVDHRNITIWLKYTEMEMRSRQVNHARNLWDRATVLLPRVNQFWYKYTYMEEMLENVPGARAVFERWMDWQPDEQAWQTYINFELRYKEIDRARQIYERFVITHPEVKHWIKYARFEENHGFIHSSRQIYERAVQFYGDEHLDEKLYIAFAKFEENQKEHDRARVIYKYALDHIPKDETKELYKAYTIHEKKYGDRSGIEEVIMSKRKLQYEQEILQNPTNYDAWFDYLRLVEGEDDLDITRETYERAIANIPPTKNKQFWRRYIYLWINYAIFEELEAKDYERTRQVYKACLEILPHKIFTFSKIWLLFAQFEIRQKNLTTARKILGMSIGMCPRDKLFRGYIDLEIQLREFDRCRKLYEKFLEFGPENCITWMKFAELETLLGDIDRARGIFELAINQARLDMPELLWKAYIDFEISQDEPDNARQIYERLLERTSHVKVWLSYAKFELNNPTEDELNVRLARRIFERANENLKSSPEKEARVLLLENWREFENNHGDESSKEKVNAKVPRRIKKRQKVVDEDGVEQGWEEVFDYIFPEDEASRPNLKLLAAAKNWKKKAEDGDEKENTNIVVKSSSDRIREKLLASAKNWKKKQDGLKENNPEENTSEDKQEDNNPILEQETESNDLDNENQNFSNENDSNDDSS

SEQ ID NO: 11214 - protein, 476 aa, Diabrotica undecimpunctata; identical to SEQ ID NO: 11102

SEQ ID NO: 11215 - protein, 160 aa, Diabrotica undecimpunctata
MSMVTSPSIELSSYRDQHFKGTRAEQDGLLRLSTTLYVGNLSFYTTEEQIYELFSKCGDIRRVVMGLDKYKKTPCGFCFVEYYNRADAENCLRYINGTRLDDRIVRTDWDAGFIEGRQYGRGKTGGQVRDEYRTDYDSGRGGYGKIIQQKIGIETPAFLR

SEQ ID NO: 11216 - protein, 228 aa, Diabrotica undecimpunctata
  misc_feature (213)..(213): Xaa can be any naturally occurring amino acid
MAATIGRICGAGLLKPTNLSSVGQLSSYSTTKEWTRGRKALLGSLGLIAGGTGALLFALDQSVKASDLELHPPKNVWSHSGTFNSLDHASVRRGYEVYKQVCAACHSMRFIAYRNLVGVTHTEEEAKAEAEEQMIEDGPDDTGNFFKRPGKLSDYFPSPYPNEEAARAANNGSYPPDLSYIVSARHGGEDYIFALLTGYCDAPAGVVLRDGQXPLLPRWCHFDGTSSI

SEQ ID NO: 11217 - protein, 571 aa, Diabrotica undecimpunctata
MLALQQYSGSSDEDDTDKNKSKDIPVNTTEITINSEFSIKNKLAICAAPNVVPTGLDGEKMHIHPDSGELTYNPKYDVLFAPVVGPANPFKTQQQSVERNMLSGHIEKAHVSDFQFENQRRTFTSYGYALDPSISNDGHLKVVGSTDEGKDVESVKTVFETSKIRPLDKRKRKKNDNPGDIEGFLGPWGGFVDEQKVSRPTEEEQAELDEITSKKNKKGKPTEDKPIEEKSVLHIKDSVDYQGRSFLHAPQDVGVNLKSDTPPEKCFLPKSHIHTWTGHSKGVAAIRWFPRTAHLFLSASMDCRIKIWEVYNERRCIRTYYGHRQAVRDINFNNSGKLFLSAGYDRYIKLWDTETGQVVSRFTSRKIPYCVKFNPDKNKQHLFVAGTSDKKIICWDTRSGDIVQEYDRHLGAVNSITFVDENRRFVTTSDDKSLRVWEWDIPVDMKYIADPTMHSMPAVTPAPNGKWLACQSMDNKIVIFSAMNRFKINRKKTFTGHMVAGYACSLDYSPDMSYLVSGDADGKVYVWDWKTTKLYKKWKAHDNVCISVLWHPHEASKMISAGWDGVIKFWD

SEQ ID NO: 11218 - protein, 268 aa, Diabrotica undecimpunctata
MVQKKPKKKVGKKVAAAPLAVKKVEQKKEVNPLFEKRPRNFGIGQDIQPPRDLSRFVKWPKYIRIQRQKAVLQKRLKVPPPINQFSQTIDKQTATQLFKVLEKYRPETALQKKNRLKAKAEAKVAKKEEAPAKKPNTLKAGANTVTKLIEQKKAQLVVIAHDVDPIELVLFLPALCRKMGVPYCIVKGKARLGLLVRRKTCSAVALTQVDSGDRSNFNKLLEVIKTNFNDRVDEIRRHWGGGLLGSKSAARIAKLERAKAKELAQKQG

SEQ ID NO: 11219 - protein, 333 aa, Diabrotica undecimpunctata
MATLIKDVTLQENIPTHILLDKHIDFIKEYGQKESTYEYGMTDYLRISGMYWALGALELMNATPAQSIEEITEYIKNCQDPESGGISACLNHDPHILHTLSAVQILCIYNKLEAINVEGVVKYIASLQLPDGSFTGDKWGEVDTRFSFCAVATLSLLNKMDAIDVNKAIDFVIQCKNFDGGFGSRPLSESHAGLMYCCVGFLSITNRLDAIDRDTLAWWLCERQLPSGGLNGRPEKLPDVCYSWWVLSSLTMLGRLHWIDANALKHFILACQDTETGGFADRPGDIADPFHTIFGLAALSLLGHDSVKKINPTYCMPQEVIDRLQLKPQRLEQ

SEQ ID NO: 11220 - protein, 887 aa, Diabrotica undecimpunctata
MHQEAIQLIQVLEKTVSPDKNELEQASSFLEQAAVTNLLEFIKTLSDILRHGGNSPVARMAAGLQLKNQLTSKDSNIKITYQQRWLAFPEDVRGYIKNNVVCALGTETSRPSSAAQCVAYVAVTELPQGQWPDLIATLVNNVCHANSTEMQKEATLEAIGYICQEIDSDVLVSQSNDILTAIVHGMRASEPSNHVRLAATQALLNSLEFTKANFDQPTERNYIMEVVCEATQSPDSQIRVAALQCLVKIMSLYYQHMEPYMAPALFPITLEAMKSENDAVALQGIEFWSNVSDEEVDLAIEDTEATEAGRPPTRCSRHYAKGALQYIVPILLQKLTKQEELDDEDDWNPCKAAGVCLMLLATCCEDEIVPHVLPFIKENIKSDNWRFRDASVMAFGSILGGLESTTLRPLVEQAMPTLIDLMYDNSVTVRDTAAWNFGRICEIIPEAAINETFLKPLLESLITGLKAEPRVAANVCWAFSGLVEAAYENADVNEETGAPDTYVLSQYFEFIIQRLLETTDRPDGSQHNLRPAAYEALMEMVKNSPKDCYVTVQKTTMVILDRLHQVLQMENHISSHNDRSQFNDLQSLLCATLQSVLRKVTPEDAPHISDAIMTAMLTMFNSNSCKSGGVQEDAIMAVSTLVEVLGENFIKYMDAFKPFLYLGLKNHQEYQVCVTAVGLTGDIFRALKLKALPYCDEIMTLLLEDLRDQSVHRSVKPEILGVFGDIGLSIGSEFKKYLDVVLSTLAQASQAQVDRNDFDMVDYLNELREGVLEAYTGILQGLKGDGPTPHPDVLILEPHIPFIVQFITVVAQDTEHSDSIIAAAAGIVGDMCNVFGAPMVQFLDLDPINEMLAQGRRSRVNRTKTLANWAVKELKKLKAVNTAAAAS

SEQ ID NO: 11221 - protein, 500 aa, Diabrotica undecimpunctata
METILEQQRRYHEEKERLIDAMVKEMLHKKTTFREAINSDHRQKYLLDRYMASTERLIDLYDDRDGQRKAEVAALTGPNEFQEFYSRLKLIKDFYRRHPNEISVPMSVEFDEFAKARENPNEDMANFVEFTDEEGYGKYLDLHECYEKYINLKGIEKVDYITYLGMFDQLYDIPKERKSGEYKKYLLCLIEYLTWFVQRIKPLKDLDIDLQEQVEQVLAIWDTGSVPGWPKETGSALTNVGAHLDLSAFSSWEELASLGLDRLKSALMALGLKCGGTLEERAQRLFSTKGKGFLDPSLMTKNNKGKANKEKELLRQRELATLEAQVYRLAEWVSPQRAATKENVQRKQARTDGERDDSENEESDDDSPDEADDDVPYNPKNLPLGWDGKPIPYWLYKLHGLNISYNCEICGNYVYKGPKAFQRHFAEWRHAHGMRCLGIPNTAHFANVTQIEDALALWEKLKVQKQSERWQPETEEEYEDSQGNVVNRKTYEDLKRQGLL

SEQ ID NO: 11222 - protein, 212 aa, Diabrotica undecimpunctata
MTIGKNNKMVQHINFRVRVTLQDSRTFIGTFKAFDKHMNMILGDCEEFRKIKSKMSKVEREEKRVLGFVLLRGESIVSLTIEGPPPPEEGLPRVPIPGAAPGPGIGRAGGRGMPPGMAGVPVGLQGPVRGVGGPSQQVMTPGGRGQVSAPPQMNQGPPRMGGPPPGMMGPPPGMMGMAPQMGMGRGGPPPMGMRGPPPGMMRGGPPGPPRPF

SEQ ID NO: 11223 - protein, 313 aa, Diabrotica undecimpunctata
MLFHFFCNDVPVIDKILLLCCRYLASGCSMGELHYSYKIGRSTVAGIIHEVCKVLWRELKTVVMEIPTADKWREIANGFEKHAKFPNCIGAIDGKHIRLFQPAQSASLYYNYKHFFSLLLLALCDANYCFTWVDIGAYGKNSDSGVFQESTLYRMLMEKTLNIPEPTAITGGSIVPYVIVGDEAFALMENLMKPFGGKLLTYEKKIFNYRLTLARRYIECTFGIMCNKWRILHRPLDVNINFAEDIVKAICVLHNYVRQRDGSTFEETLYTAPLTNLQQSSTRRTGRVTENVRNKFMHYFVNEGKVDWQNSMI

SEQ ID NO: 11224 - protein, 5058 aa, Diabrotica undecimpunctata
YFPEHWPGKVCAFCNLGERSQLGQGEMLRLNCPEGFLPHKVAAEQILEKALQAPDKDRGDKSPKGPVTCRRQKGFNKCRHPSMNSEYVDELTIIGYNEVSDVTSLFEPNGQFYVHRSCALWSHGVTRAENSALLDVGPVVLQCSSKKCSLCNHYGASVTCNLDSCNKVFHFPCATAAGAFQEIMSISTFCSNHIGQVAMLNEATPCFTCRTMGDISNLMYCSTCGAHYHGTCVGLAQLPGVRAGWQCRKCRCCQVCRTVGDESKLMSCEQCDKVYHAGCQRPIVTSIPKYGWKCRCCRVCGDCGSRTPGAGLSSRWHAHYTVCDSCYQQRNKGFSCPLCHKAYRAHAHREMVQCSNCKKFVHGTCDAEADVATYHQKKDLNPEYEYVCLHCKNSTARQITAKRASIEDSSDVPASHESLYDDTSEFDLPSPDEFARSMGMGKGKPFASKIAKKRINFPIAGRPKGTGKVPPGKMGFMKRSRLSDFNRKRGHKSKMCGIFGVPGVGLQRPTADGKSDEEPGVENRLVLCSAKDKYTLTQDICVMCGALGMDQEGCLISCVQCGQCYHPYCINVKITKVILEKGWRCLDCTICEGCGQRNDEARLILCDDCDVSFHIYCMDPPLDYVPHGNWKCKWCAMCLNCGATDPGFNCNWMNSSTQCGPCASHLNCPSCNEPYGDGELIIQCVQCERWLHGSCDCIKNEDDAEKCAEDGYNCILCRPRDVPPPHLVPPPPAPKPPTPTKSPEVGKSSSFYLDGVYLSEMGNSFIKSLALEHHGSRKKRKKLPTVQDKEAGIMATIESVIAGGNAGGATALEDSAKLELVDVKDEPQELYKEGMIWTKEDGPAPEGFTVFTMESGISVLRRKRQRNLQKLGIGGFLVRMRGIRTGQDNDEIDSSVIQSGSATPTELLPPMPVDGDKPKRKPIRRKPKSKLAETFPAYLQEAFFGKDLLETVDCKKEVDSCSSDDEKSVKYKSINLSQDELMAVAAVSGKSEKQAIASIKDSLKDIKSSPMIKEEDDDNTEDLKDVLALPGDLLDAEIVNSIMEDDDELTKNTESLEVLDTNLQDDTELTDTLGSSGNSKETKDELSDILGPHFNLESISNINSKDVEDIFKGVLTDESQESQESSNFAIQGSNLFSNNTPQPSLAQHSMMTPAVRPKTLPNVSQVNLNSPVGFPPPSPYHSEYSNSPQFSPAFTESPNAWVGVPETPEIDSTNVGVPSTYNQRSSEKMKADESLGNGATISAVLYANMNHPEWKKDFPVWSDRYKQIIKKWRTLSQEQKAPYLQHARDNRSQLRMKKAQQSQTSKESTASASTPNVTKPVHAVPALVTTLQAVSQQPVGVTTAPTAPITEDQEKMALQQKSAREAEQERQWKQLQAMRQQQTQQQQNIIHEQRVQAIARVQRQISVDPAQQFLSEQQSPLQPSTPQELSPSATPTPSPRQFIGMKSPTFPLPSPVAQTAIRPPTPSHSPHDVSQASTPDGNDHFIQSPSTPKPNFPTRLPTDQFIHQPATPRPQFGIQRPPLQNFGNTMRTDQQDININRQLRDLLQRQQVKKLDELLPGKVQQQRVWPPIEQQENEASATTGTSAVVATTADTTFRQPLPPSIVRPRVALSLAGRAGPGTIRVGQLDARMQGLDPRMRLILQQQVGQQRLSTGIQHQFVRFTSTPARPATLDQYEQLLHRPTATQIRAPDQQNAPRMTLNQASVIQRPQMVQPTQSTPATSAADSNPSEEGIPDNVTAELEKLEQETGTMVELQGVSEILGGLGDDDDELLAEMGADFNILEYADPELEALTGGKTNILDLELEEEPVKKEKIVSSAENQPTNQTVNAISSPVKPKHEEPVETPAPKPEPASLPPPPPPLALPQQQPAPVQHTPPVAIQQPTPHPPQVQPTMHLTPQQIHQQMVHQVQQAAAQGRPMPPGSKMQTPDGFIGIVMPNNSVQLQIPQNYQQRLLLLQQLQNQKLQMRVGTTTPRVAVVAQSQLPVGLATGPRMVAAPPPPPPPPYPGPPPPYPGNAAQHQQEQPLLLEDLLEQEKREQEKLQNQPSSQEVSSSTGNESESALLSDHDFERLKADVFNTGPVTSLPSTNNQGTASHTNQPWQQLQNRQIPAPPAQPTLEVTTRVQMFNANLIAAPPLPPENIVTEQDKQTQMMYEQWLNHQNNVLAQQLRYYETEVQKLRKSRKSLNSKQRQLKKSGNQLTDTDAAELQRISAEQAILQKHLESSRKQSRQHGMLIQEYRNKHPAPKQRVEQIQSPLGPPSSSPLQHPSTSQSPMLSPSLSPLTQHNSPLNSPGPLISSSPGSVSVQNILQSPNSMPTNSMSPLQSSSMQASPMQQSPMQPSPRIGTPHSQSEESPGSAQSPSQVCLPPPMPRMTSPQHRRVVTSPVGMTQMRFVSNQVLQQRVRMQSPIQNFQQKPATPSPLNSPTSQTMNVSQQLQLHKLQQQQSMLQQQSLDGNQGDPNIIHSQRTTQLLQHRNFIRQQVAQQQQQQIGQPQPLTPQQHQMMLQQQKQLAQQQQQQIAQMNAARLQQQNNPPHSPMPPKSPMINQQIMSPHSMPPSPMQMPPKSPMVSFSSSNQPNPNSPAARSPAFHQGLSQTPTSPMTHQPPSPMPRSPMVNQTQSPHSMRRPPSANSSPAMPDRPLSVENPSPRMSYSIDHLMQDTLHSQSSHNSMQFTDNFTTDMNIQNSIRENMQSGGGNPNNPCNPIPLPPEYPRFRYFKLGLRGGTPMWGFGRGAKRIPTPPNAPNKPEEKLVNQDSMMLQKMKKEPHLSKVSLLKRKVGAGSGKIGSLVSTDYNDMDDSSSTPPITPPLATTSRGGIPKTLPKKILENQSSKDSVIVMHSPEDKQLDMMDFDDDTNTVLSAEVSLSSAAQNDEDMLEMETLSQQDLAEGLSSPLEPDQIADEYLLFPGNMVVDMSAGEHFSEKEEEEETVDEEFNDENMHIMIRSPTTSDYEYIMQSKGKKYNVGVHDENDDMPESPDQEDLAVPSPEVSDLLTNYDENDVLMGDQSNSTPEESISTKEDFEELIDEGSRKNSITKSEVTTKQINEFHKYAGIFNYSKGVVQATQNQTALNKITSVANKKAPAKISLVAGPIVHNLSTGKVNPEKLIITQNPNILNTSQAAKVTSIILTHNSAVRRNVLNVPKIVSTVSPAITIVNATTSQMASILPSKFTVPVISASAVRQLSNVKVIDKPSSSSLSISTRDNVLPKKIFEDDSVSPDSSNCEDDKSKDSFDEKGKLESPSREIKPLLKTDASSSNTIIARSLEYKTHDHQKKAEHLQVMNIIQKQRIPSPLMPKSASPVIIHNTPELKMTAQVIQETQTRMKMTATTETLDAYDGSVDDTKSVVISIPSPTPSQEQMLDNIAYQALENRRREFDSIEDVLDMIENITAEPPAILEENVPVQNPKKNTNTETKEKDIDKPKPEIANIPVSTKSSAVPQLSPLSQPTDLTMNMANASQQLRSLLSSLQTTSTSSPTNVESVVKNFGHKISSSASPTATQPIVASRVIQQAGRQSPVVTTVNTVIVPNLKQKVTVTSASSSRNSPVKTQVVTTQHIPSSAIITSTINYIPNRTIASMQVMTEHLKLSSGSMSITTPSVSTQQAIAKTTSHNESKKPSLTLTAMLQNQPAANMITKSSADTITAASLLGSPISLPKTGFSTSLVQAQPTVVVPVITTSMIALQTQPSIVSTVKSSPMKTIADTITAASLLSSSSVNIVKTGITAALLQAQPNPTLSSLSTATPLTQTSNNIITSSTHRVPTSTTNLLHTQLTKVVRSKSVDDIKEIKQEEIKTEIMDTGVDDNKFSLISPSGCKMSTIQNPILNKGDDSQNVLLKKLLQNTACASTQSPPPTTASTITTICPTPKLPIRETSFVSSPNVELPVSQPSVAAVVPTQPLQLEIKKCLPPSRSSSRDELLSPQTPRSSTNSQDSSLQTPPIIKKEIMSVPPPQPSPIHTTHEVKKELMDESSQHSEVSDYSRPDIPIKEETEMADIAIEKPVLDKEELKKQKRRMYQQKRRQNQILNKELAGQPKKRPRKNSKIEEDYDTYIDGVLAQLRQLPGITVSEPVLNRNHGIVSLFGSGDMSKLGTKGYSTQFGDLVGKYGYAELPGYSDFYSTKPYGDLDPIPEKPPSSTQRGFYDQEFPLIRFDTDDHKKFDMFCREDTPDSILSSSSPECVQLDPQCRFMGLKLISDSESEDEDNEIEREIQQARDRLSPIVPMIKPVPIRLKPVGGLLVKETPSDNKENINTDSLNVMTKIKSENKPSIPTKDSGHVTVTLTLTSSAAEDIMGVLRDLANILQIPAPTSYQIVERTTTPPSQKLGLYRTKGKDGKEGAPIDIQSILNGATKFCKHCDVIILSNLIRRKVSDLPFLAKDSELLSDGEELFFCSSTCYMQFALMHRSPSISEDKAAEIINHLSQKDNESKQKMQMMEPFDNKSLIAQRLSFTNREMKKEYEPMDTSDYYSYLHNNAENKPNRFYDGAYRPMPVSRIYKNIKYKAWSPGCLQPNQKHKIPTDKEIMELLYRMQITVMPPVMPDDTRKCMFCQGVGDGVADGTARLLNFEVDKWVHLNCGLWSDGVYETVNGALMNLENALQTSLTTNCVHCNMLGATIRCFKTRCSSVYHLNCAVKDNCVFFKNKTVYCIAHVPKNEKDNELTTLSVSRRVYVNRDENRQVAAVMHHSDTDDLLRVGSLIFLNVGQLLPHQLQNFHTSNYIYPIGYKIIRFYWSMKSLNKRCKYICSIHEQYGKPEFRVIVQEPPEDDIEFIDPTPKGAWQRILDQIAFLRKENECLQMFPKFTTGEDLFGLTEPAIVRVLESLPGIETLPDYKFKYGRNPLLELPLAINPSGCCRTESRSRIQLHWKKHHTQRTTLSTARPLFGPSPSGPTPSTPTLGELSCPYSKQFVHSKSSQYKKMKQEWKNNVYLARSKIQGLGLYAARDLEKHTMVIEYIGEIIRTELAECREKQYEAKNRGIYMFRLDENRVVDATLSGGLARYINHSCNPNCVAETVEVERDVKIIIFSKRRIMRGEELAYDYKFEFEDDQNKISCMCGAPNCRKWMN

SEQ ID NO: 11225 - protein, 423 aa, Diabrotica barberi
VDAVEMHEPYTYLNGLHIKDLEDLVEDIKVYKELERGKNLDYWNDITVIVEDELQKLRKLEKQNDFDLGLNRREGIHQSVAGDVTSVFKGKTAVQLAALEKQIEGKISGKADGIDIGYWESLLSQLKAHMARARLRDRHQESLRRKLQVLKAEQAIIVTAPSESHSSGGEEAPTKDVQEPKPGPSQEPDDKQNDEEEPADEEAANSWLNECFDAYEAGGYSPKFLTPDEIEPGTIVVIEEDDLKRLEFARIQVVGKGKTVENVITKEELMLQKEARKGMDGDEAQFSVEQALDSQVYLWSDKYRPRKPRYFNRVHTGFEWNKYNQTHYDMDNPPPKIVQGYKFNIFYPDLIDKSSTPEYFLTPCPENKEFAILRFHAGPPYEDIAFKIVNREWEYSYKRGFRCQFHNNIFQLWFHFKRYRYRR

SEQ ID NO: 11226 - protein, 420 aa, Diabrotica barberi
MDNLETNIMDKSMRSVFVGNIPYEATEEKLKDIFGEVGQVLSFKLVFDRETGKPKGYGFCEYRDQETALSAMRNLNGYEIGGRNLRVDNACTEKSRMEMQNLLNQPPVENPYGEAVQAEKAPEAISKAVASLPPEQMFELMKQMKTTIQNNPTEARQMLLQNPQLAYALLQAQVVMKIIDAATAVSLLHPVNQVPATLMPGDKNVPVQVPVNNQYREPPAPVQPPVHPRQDFQPVPPPVMHPSQNQVFPSQDIDLRSIGGVPDLRNLRPMGDQDMRQMPSAIQNPLPPTIGESFIRDPRAAQAFAGDPRQARMDPRQKPMVPPPQGQMPIPPPIARPPVMPPQPQVPVTRAAPLPQPSPAPTPATASPNVANAGASDQEKAALIMQVLQLSDEQISMLPPEQRNSILVLKEQIAKSAHTR

SEQ ID NO: 11227 - protein, 333 aa, Diabrotica barberi
MTQMDPEREKSLQEYRKKLLEHKEVESRLKEMREQLKDLTKQYDKSENDLKALQSMGQIVGEVLKQLTEEKFIVKATNGPRYVVGCRRQLDKAKLKAGTRVALDMTTLTIMRYLPREVDPLVYNMSHEDPGDVTYSAIGGLSEQIRELREVIELPLLNPELFMRVGITPPKGCLLYGPPGTGKTLLARAVASQLDANFLKVVSSAIVDKYIGESARLIREMFNYAKDHQPCIIFMDEIDAIGGRRFSEGTSADREIQRTLMELLNQMDGFDSLGQVKMIMATNRPDTLDPALLRPGRLDRKIEIPLPNEQARLEILKIHALPIAKHGEIDYEA

SEQ ID NO: 11228 - protein, 258 aa, Diabrotica barberi; identical to SEQ ID NO: 11004

SEQ ID NO: 11229 - protein, 913 aa, Diabrotica barberi
MGDTKVEPTKVDKAKGTEDKNKNELSEEDKQLQDELNLCVEKLQDNDEKRYLPALQALSNHIQASTTSMTSVPKPLKFMRPHYETMKTVHEKITDPDTKKVCADIISVLAMTMGEGRECLKYRLLSNLDKIGEWGHEYVRHLAGEIAGEWAETDFIVNTEIREKLILLTKQIVPYNMAHNAEAEACDLLMEIERLDLLEQYVDENIYHRVCLYLTSCVPYVADPENTTLLQTALLLFRKFDQYPQALRLAMQLNDFGLIEEIFVNCPDSDVQKQLAFMLGRQQIYVEIPEHTPEYEDLIEIMANCHLNNHFLNLARELDIMDPKTPEDVYKSHLENSRPPFGGNQVDSARQNLAASFVNGFVNAAFGQDKLLMEDGNKWLYKNKEHGMLSATASLGLILLWDVDGGLTPIDKYLYSSEDHIKSGALLACGIVNCGVRNECDPALALLSDYVLHNTNIMRIGAIVGLGLAYVGSNREAVLSLITPVLSDPKSNMEVIGMAALACGMISAGSGNSHVTTSIMQVLMEKSEIELKDTYARFLPLGLGLCHLGKQESIDTIIAALEVIPDPFRSMATTMVDICAYAGTGNVLKVQHLLHICSEHYDAPETPDKTSKDKDKKETEKEKDKDLSARQALFQPPDKTSKDKDKKETEKEKDKDLSARQAIAVLGIALISMGEDIGSEMAFRTFGHLLRYCEPAIRRAVPLALGLISVSNPKLSILDTLSKFSHDSDAEVAHNAIFAMGLVGAGTNNARLAAMLRQLAQYHAKDPNNLFMVRIAQGLTHLGKGTLTLSPFHSDRQLMSPVAVAGLMATLIGFLDVKNIILGKSHYLLYTLAAAMQPRMLVTFDDELNPLPVPVRVGLAVDVVGQAGKPKTITGFQTHTTPVLLAYGERAELATEEYIALTPIMEGFVILRK

SEQ ID NO: 11230 - protein, 286 aa, Diabrotica barberi
GSDYEGGTMFNGNFEGTYGTAYAHGIHGGSYSPSNKQHLGVNGAQGVQSPNKPRNKSRTSAEGRECVNCGATSTPLWRRDGTGHYLCNACGLYYKMNGQNRPLIKPKRRLSLQSAARRAGTSCANCKTTTTTLWRRNQNGEPVCNACGLYYKLHNVNRPLTMKKEGIQTRNRKLSSKSKKKKSGASCLSLGGMMGDMMKPLDSKGAFGGGFGAGMGGGHPHLNAALHPHHAMTHWHQYQHTQGFVSGPPPPAPPSAASYHHHMSSLSAAGLGLTSNGMTSWRSEYT

SEQ ID NO: 11231 - protein, 1669 aa, Diabrotica barberi
MALPGNGIFVVKGEISNMMAAMKRGTRWSSHSYQDDDVDSLLRNFQELRDILDNVDDLRFVEPNTFLAPFLNVIRSEETTGPVTSLALSAVNKFLSYGLLDPLHASIPQTIHSIADAVTHARFVGTDQSSDGVVLIRILQVLRTLTLSPEGTALTNESLCEIMLSCFRICFETRLVDLLRKTAEHYLKEMVQLIFMRLPQFSEDLKVSYIKQLKMKPGALDQTRTKRKKQYSSLKKDKSDTDIKSPQTPQGNLAAVAQSSIVDMQGSLQNPENANPVTPNASPKENFKCDVDIVVDSPVSNNEDLKNIDSISSGVEEAATEPKSLTEEEITEEQSQSTQDYINQRGIRFTPQLQQEANLSPYGLACVRELLRFLISLCNPLDKQNTEIMIHLGLTLLTVAFEISADNIGKYNTLLALVKDDLCRNLFSLMNTERLAIFSLDLQVSFLLFESLRTHLKYQLEHYLKKLIEIILSDSPKVTYEHKEIALDNLLQLWRIPGFHTELYINYDCDMYCANLYEELTKLLAKHSISSNTGVYHTHLLSLDALMIITEGIENRCCEEKDRLDAGNSELVQQSNDISFYVGKNSRTKVSPIMPKKEELAQKKSIKKWLPQGTEYFNKKPKKGIEFLQEHGVLKQDIDLDEIARFLRENPVLNKAMIGEYISNRSNLKILQSFVDTFNFVGVRIDEALRAFLETFRLPGEAPTISLILEHFAETWHKANNEPFADVDSAFTLAYAIIMLNVDQHNENAKKQTTPMSANAFKKNLKGVNGGNDFDEEMLDDIYTTIKNEEIVMPAEQAGLVRENYFWKILLRKGQTKDGIYIHDNSGTYDSELFQIVYGPIVAALSSVYEKAENESVHKKVMQGFERCAFIAANLNISTNLDMLILGICKFTVFYNQQKQNNIVVQFGMNSKAQLALRTVFSLIHQHGNTMREGWKHLFDLLLALYSNGLLSKTFVEVEDFIEPSGKLMLVYKEAPSAAKQDTGLLSSLYSYMVSAENLSKIPTPEEQNCIDAAKECIKDCNLEQMITDSKFLHEEALFELVKTLIELSRGPDVHESVAYDYNDNVTVFFLELLIKVVIQNRDRVMTVWQNVRDHIYTLVMNASVFDFQFLLERSVIGLLRIAIRLMRNEEMSHIVLQSLRMLLLLKSSTLSRISRQISFGLYELLKTSAQNIHTNTDWTIIFTLLECVGAGAQPPKPVSSAEDTELKSKSDGETSDNHEEEGTLSDSEGRKSPKDNTQRSQSPVSVVTSPVGTPNTGGWILVGNEGEIQPVMGRTVPPTQYGLALEKNLGSHDPRSMMKCCESLAFLVRDVAHITPYNFDVCVHCIRTFVEASLHGSNFKRLRDSRSRKKTLDRTRTRKSPTSSPDEEDSDDENIPSGYQQISIQLLDLMHTLHTRTAQIFKWWAEEGGEISQETSLWTQGWCPLLQGIARLCCDTRRPVRMSAITYLQRALLVHDLQTLSGSEWEQCFQRVLFPLLSYLLQSINPKDAISMEETRIRVATVLSKVFLHHLTPLLALPSFFNLWLVVLDFMDKYMHADKSELLYEAIPEALPSFFNLWLVVLDFMDKYMHADKSELLYEAIPESLKNMLLVMDSAKVFDGPDGKNILWNATWERIGKFLPNMKDDLFKEIEDQNRKNEEVSNIEIIVNKEEKDVNTEKLTTNDNLITC

SEQ ID NO: 11232 - protein, 261 aa, Diabrotica barberi
SISLFHVCKYVCRLYSVYCILVFYNSLNCRLFSSLVQKPEVNSIIYNEKCLNFSGKMSILAYNGGAMVAMKGENCVAIAADRRFGIQAQTVATNFQKIFEMGPHLYVGLPGLATDTQTVMEKLRFRKNLYELKENRKISPKVFASMISNMLYEKRFGPFFVEPVVAGLLPNTYEPFICNMDLIGCINQPSDFVVGGTASAQLYGMCEALWEPNLGPEDLFETISQALINAFDRDAISGWGATVYIIEKNKVTVKNLKTRMD

SEQ ID NO: 11233 - protein, 935 aa, Diabrotica barberi
MDQKPDIDLVISAVSALYNNPNSSEKERASKWLLELQKSVHAWTVADELLHLKRDLESCYFAAQTMRTKIHQSFHELPQEVHTSLRDSLLEHIGQINEATNTVIVTQLCVALADLALQMPSWQNPTLDLINRFSQTNIWPLLEILTVLPEELESRSVRLGENRRIDVLEEMKISAPTVNEFLKHCSKLYETNWQDHVQFNVKILRCFTSWISVGAISLNDLSDSIVINRAFEILNFKPQNDKHTISAAFHEAATDCICTLLLSLENNNNQLGLENYLFNNIINLDVPYHLSVANEDQGKSMDYCRLFTELAESFLEKIIANSNTKQMHYAIKILDLVLMCVGHHDYEVAEITFNLWYVLSEELYQKNNKEKTELFRPYVERLITALCRHCQMEPDSEGLLEDGDEFKDFRLKVAELIRDVVFIVGSSACFKQMFINIQGPGVTWDSTEAALFVMQAVAKNVIPGESEVVPQVVEAILNVPENTHVAVKYTSVLLLGELCEWIERHPNTLDPVLNFLVCCLPQPGVGAAAAVALQNICASCNDHMPRHVPILLQLLHQADSFAITNTATLGLLRGVASIIGRMPHEELTTALRELCSMQLNPICQIIEQDVHPVKGAQTDPVMWLDRLSAVLRYVNVHIPEGVENPCKPVILEVWPVLSRTFDKFQSDIRIMERCCRAVRFMLRCVAQEVRELLESLVGQIVRIYTLYQHSCFLYVGSILVDEYAIDPICVPGLLDMLQAFLEPTFHVLQEENGLKNHPDTVDDFFRLCARFMQRAPLAFLKCSSLVHILQCALLASSLDHREANMSVMKFFYDLINQGQSGRADPEFNQRQMLVKSILDEYGQQLVSNLIHSCVFYLHSYMLSEVGDVFVQLLDFDREITCKWVAAGLDVLPKNSNGGIMAATPQQLTDIHTTISRANTSKSVTHALKDLARLYR

SEQ ID NO: 11234 - protein, 518 aa, Diabrotica barberi
MAQRFPGPVPNQSPGGPPPQRYQQQPPNQGIRQYAQQNFPQRPGYNPPPPNIPSSGGTMIQRPAGAPYSPMRGGIIPPQQGNKRPADNRTQMQQKSNEYSHSTSKKKKKLADKILPQKVRDLVPESQAYMDLLAFERKLDSTIMRKRLDIQEALKRPMKQKRKLRIFISNTFYPAKEPQPEGPDGPCQEGTVASWELRVEGRLLEDPKNDPNKVKRKFSSFFKSLVIELDKELYGPDNHLVEWHRTLTTQETDGFQVKRPGDKNVRCTILLLLDYQPLQFKLDPRLARLLGVHTQTRPVIISALWQYIKTHRLQDAHEREFIVCDKYLEQIFNCTRMKFAEIPQRLNPLLHPPDPIVINHVISVEGGAESKQTACYDIDVEVDDTLKTQMNNFLLSTASQQEIQGLDAKIHETVDTINQLEGGAESKQTACYDIDVEVDDTLKTQMNNFLLSTASQQEIQGLDAKIHETVDTINQLKTNREFFLSFAKDPQQFIHKWIVSQTRDLKTMTDVVGNPEEE

SEQ ID NO: 11235 - protein, 144 aa, Diabrotica barberi; identical to SEQ ID NO: 11011

SEQ ID NO: 11236 - protein, 294 aa, Diabrotica barberi; identical to SEQ ID NO: 11012

SEQ ID NO: 11237 - protein, 402 aa, Diabrotica barberi
MAIPNRGASVFEDLSNVEFETSEDVEVIEKFKNMNLKEELLRGIFAYGFEKPSAIQQRAIKPIMKGRDVIAQAQSGTGKTATFSISILQALDLTMRETQVLCLSPTRELAVQIQKVILALGDFMNVQCHACIGGTNLGEDIRKLDYGQHVVSGTPGRVYDMIRRRALRTRSVKMLVLDEADEMLNKGFKEQIYDVYRFLPPSTQVVLISATLPHEILEITSKFMTDPIRILVKRDELTLEGIKQFFVAVEREEWKFDTLCDLYDTLTITQAVIFCNTKRKVDWLTEKMRENNFTVSSMHGDMPQKERDNIMKEFRSGQSRVLITTDVWARGIDVQQVSLVINYDLPNNRELYIHRIGRSGRFGRKGVAINFVKSDDIRILRDIEQYYSTQIDEMPMNVADLI

SEQ ID NO: 11238 - protein, 534 aa, Diabrotica barberi
MTAPTAGGDTNRGRTVAYKDKSKPADVRTSNINAAKAVCDAIRTSLGPRGMDKMIQAGNGEVTITNDGATILKQINVIHPAAKMLVELSRAQDIEAGDGTTSVVVIAGALLDAAEKLLHRGIHPTAISESFQRAAQLAVDILSDISTPIEITNRELLIKSASTSLNSKVVSQHSSFLGPLAVDAVLKIVEPGREQACNLSDIKVIKQLGGTVEDTELVEGICFPQRSANVSGPKRIEKAKIGFIQFCISPPKTDMDHNVIVSDYAAMDRVLKEERAYILNIVKQIKKAGCNVLLVQKSILRDAVSDLALHFLDKIKCMVIKDIEREDVEFVCKSLGCRPIASLDHFVAENLVTADLVEEVGLAGNRMVKITGAQNAGRTVTLLVRGSNKLVLEEADRSLHDALCVIRCLVRKKALIAGGGAPEVEVALKLAAMANKLEGIDAICTRAYANALEIIPFTLSENAGLNPIQTVTELRNRHAKGETSAGINVRKGAITDILEENVVQPLLVSTSALSLATETVRSILKIDDIVNTFT

SEQ ID NO: 11239 - protein, 371 aa, Diabrotica barberi
MEAMDIVIPEKEEGSPSEVKQVLQDVDTEDLYTKYKKLQQQLEFLEVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVQYSDIGGMDMQKQEIREAVELPLTHFELYKQIGIDPPRGVLMYGPPGCGKTMLAKAVAHHTTAAFIRVVGSEFVQKYLGEGPRMVRDVFRLAKENSPAIIFIDEIDAIATKRFDAQTGADREVQRILLELLNQMDGFDQTTNVKVIMATNRADTLDPALLRPGRLDRKIEFPLPDRRQKRLIFSTITSKMNLSEEVDLEDCPFETWSSGQKNRISVTR

SEQ ID NO: 11240 - protein, 144 aa, Diabrotica barberi
MPNIKLQSSDGETFEIDVEIAKCSVTIKTMLEDLGMDEEEEEVVPLPNVNSAILRKVIQWATYHKDDPPPPEDDDNKEKRTDDISSWDADFLKVDQGTLFELILAANYLDIKGLLDVTCKTVANMIKGKAPEEIRKTFNIKNDF

SEQ ID NO: 11241 - protein, 309 aa, Diabrotica barberi; identical to SEQ ID NO: 11017

SEQ ID NO: 11242 - protein, 316 aa, Diabrotica barberi
GMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGK

SEQ ID NO: 11243 - protein, 322 aa, Diabrotica barberi
MMQPQILLLKEGTDSSQGKPQLISNINACQNVTDAVRTTLGPRGMDKLIVQRQGHATISNDGATILKLLDIVHPAAKTLVDIAKSQDAEVGDGTTSVVLLAGEFLKQIKPYVDEGVHPRIIIKAVRRSFQICLEKISEISVKINKSNADEFRSLLEKCAATAMSSKLINQQRSFFSKMVVDAVLLLDDLLPLNMIGIKKVQGGALEESLLVAGVAFKKTFSYAGFEMQPKVYKDCKIALLNIELELKAERDNAEVRVDNVKEYQKIVDAEWTILYNKLQKIYESGANVVLSKLPIGDVATQYFADRDMFCAGRVQEDDMKRT

SEQ ID NO: 11244 - protein, 1215 aa, Diabrotica barberi
MMVGPSGSGKSSAWRVLLKALERFEGVEGVAHVIDPKAISKEALYGVLDPNTREWTDGLFTHILRKIIDNVRGEINKRQWIIFDGDVDPEWVENLNSVLDDNKLLTLPNGERLSLPPNVRVMFEVQDLKYATLATVSRCGMVWFSEDVLSTDMIFENYILRLRNIPLEESEDSGFGKKNDKDDMLSPTLQLQVDVVNLLQPYLSPDGLVVRCLEYAMEQEHIMDFTRLRALSSLFSMLNQAVRNVLQYNHMHPDFPLTNDVLDKYIPKCLIYSILWSFAGDAKLKIRSDLGDFIRSVTTVPLPPDNNMPIIDYEVTIEGEWSLWSNKVPQIEIETHKVASPDVVVPTLDTVRHESLLYTWLAEHKPLVLCGPPGSGKTMTLFSALRALPDMEVVGLNFSSATTPELLLKTFDHYCEYRKTPNGVVLSPIQLGKWLVLFCDEINLPDMDNYGTQRVIMFLRQIVEQKGFYRASDQSWVALERIQFVGACNPPTDPGRKPLSHRFLRHVPVIYVDYPGETSLKQIYGTFTRAMLRLAPGLKGYAEPLTNAMVEFYLASQDRFTQDMQPHYVYSPREMTRWVRGICEAIRPLDNLAVEGLVRLWAHEALRLFQDRLVEDTERRWTNENIDAVALKHFPSANCEKALERPILYSNWLSKDYVPVGREQLREYVKARLKVFYEEELDVPLVLFDEVLDHVLRIDRIFRQPQGHLLLIGVSGAGKTTLSRFVAWMNGLSIFQIKVHNKYTAEDFDEDLRSVLRRSGCKHEKIAFILDESNMLDSSFLERMNTLLANGEVPGLFEGDEYTTLMTQCKEGAQREGLMLDSNDELYKWFTQQVMRNLHVVFTMNPSTDGLKDRAATSPALFNRCVLNWFGDWSDGALFQVGKEFTNRLDLEKQSWRCPDFFPAACHHISASPTHREAVINACVYVHQTLHKANSRLVKRGSRTMAITPRHYLDFIHHLVKLYNEKRSDLEEQQLHLNVGLNKIAETVEQVEEMQKSLAVKSQELQAKNEAANAKLRQMVKDQQEAEKKKVQSQEIQQQLAEQTIHIEQKRSEVMADLEQVEPAVIEAQLAVKSIKKQQLVEIRTMANPPALVKLALESICLLLGENASDWKSIRAVIMRDNFINTVVNNFNTEDISDDVREKMKNRYLSNPDYNIDKIYHASNACGPLVKWACAQVQYADMLKKVEPLREELKSLEQQAETNQKRGEDVKALIS

SEQ ID NO: 11245 - protein, 892 aa, Diabrotica barberi
FRMDRPSTSKRNVFDSDSDSVDSTEEARRRDLKERDEFANRLKKRDEERTRNVASTSDKRAYEEAAKRLKLDNAEKEKLIPALRVASRRKYLEKRKEDKLQELEADIADDEYLFEEDVLTEREKKDRVHKKELLKLAQEHEKARELERVQRYHMPRDLGKDSTADYIEVDDLEKVPQSEQKKWEKDQMASAVFKFGAKDGIKKEEYELVLEDQIQFIQALQMPGVSDKKEPQLTETEKKKLTIEETKKSLPIYPFKDDLIQAIREHQVLIIEGETGSGKTTQIPQYLYEAGFCEDGKKIGCTQPRRVAAMSVAARVAQEMSVKLGNEVGYAIRFEDCTSERTVIKYMTDGTLHREFLSEPDLASYSVMIIDEAHERTLHTDILFGLVKDIARFRPDLKLLISSATLDVTKFSDFFDDAPVYQIPGRRFPVDIYYTKAPEADYVDACVVSVLQIHVTQPLGDILVFLTGQDEIETCQELLQDKVRRLGSKVKELLILPLYANLPSDMQGKIFEPTPPGARKVVLATNIAETSLTIDNIIYVIDPGFAKQNHFNSRTGMESLMVVPISKASANQRAGRAGRVAAGKCFRLYTAWSYKHELEDNTIPEIQRINLGNAVLMLKALGINDLVHFDFLDPPPHETLVLALEQLYALGALNHHGELTKLGRRMAELPVDPMMAKMILASEKYKCSEEIVTIGAMLSVNGAIFYRPKDKIIHADTARKNFSHLAGDHLSLLNVYNQWRDSDYSLQWCYENFIQYRSMKRARDVREQLVNLMTRVEIEIVSNVSETVDIRKAITSGYFYHIARFSKGGSYKTVKHNQSVTIHPNSALFESLPRWVLYHELVFTSKEFMRQVIEIESKWLLEVAPHYYKQKELEDPTNKKMPKTVGRSTRTD

SEQ ID NO: 11246 - protein, 456 aa, Diabrotica barberi
MKVEEVKSTVKTQRISAHSHIKGLGLDEAGFAIPSAAGLVGQEQAREAAGIVVDMIKSKKMAGRAVLLAGPPGTGKTAIALAIAQELGNKVPFCPMVGSEVYSSEIKKTEVLMENFRRAIGLRIRETKEVYEGEVSELTPVETENPAGGYGKTVSHVIIGLRTAKGSKQLKLDPSIYEALQKEKVEVGDVIYIEATSGAVKRQGRSDAYATEFDLEAEEYVPLPKGDVHKKKEVIQDVTLHDLDAANAKPQGGQDVLSMMGQLLKPKKTEITDKLRKEINKIVDKYIDQGIAELVPGVLFIDEVHMLDIETFTYLHRALESAIAPIVIFATNRGRCLIRGTDDVYSPHGIPLDLLDRLLIIRTIPYGRNDMEQILKLRATTEGLEIDHEAIASLGEVGAKATLRYAVQLLTPAHLTAKINGRNNILHSDIEEVGSLFLDAKASAKVLSENKEKFMT

SEQ ID NO: 11247 - protein, 732 aa, Diabrotica barberi
MTSIIKLQALSGAKDESPPCYILQIDEVRILLDCGWDEKFDMEFIKEIKRHVHTIDAVLLSYPDIYHLGALPYVVGKLGLNCPIYATIPVYKMGQMFMYDLYQSQYNMKEFCIFSLDDVDTTFEKIIQLKYNQNVPLKGKGYGLTITPLPAGHMIGGTIWKIMKMEEDIIYCNDFNHKKERHLNGCELDRLQKPSLLITDAFNATYQQARRRARDEKLMTNILQTLRNNGNVLIAVDTAGRVLELAHMLDQLWRNKESGLLAYSLAFLNNVSYNVIEFAKSQIEWMSDKLMRSFEGARNNPFQFKHLQWCHSLAELSKVPSPKVVLASSPDLESGFSRELFLQWCSNSNNSIILTTRTSPGTLARDLIDNGAERNIDLTVERRVKLEGVELEEYEKRQRARGQNVEKEDADSDSDSDIEMSVITKGRHDIVIKQEGKINAGFFKVTKKMYPMYPFHEEKIKSDEYGEIIKPENYKLADVAVEGEDNKENVLIKKEVEEEITEIHEQPTKCIVLQRTVQVNCQVHYIDFEGRSDGESLMKILSQLKPRRVIVVRGDEENTSVIAKHCEGIKARVFTPSRGEIVDATSETHIYQVRLTDALVSQLSFQKAKEAEVAWITANVVLKESQADAKRVYVDDEPMEVEDVDTRILTLEPVLEGDCHDPVFINELKLSEFKQVLGRHNISSEFSGGVLWCSNGTIAVRRVESGKIMLEGCISEDYYRVKDLLYEQYAIL

SEQ ID NO: 11248 - protein, 760 aa, Diabrotica barberi
MAPLESTNNNNNEEPGPINPIVGIIYPPPEVRNIVDKTASFVARNGPEFEARIRQNELGNPKFNFLNSGDPYHSYYQHKVKDFREGKGQDPTPGLTQAVSKLSVTASAQQKQQEILKQVEQPFIPKETPSEFEFIADPPSISALDLDIVKLTAQFVARNGRAFLTQLMNREQRNLQFDFLRPQHSLFQYFTKLLEQYTKVLIPPKSMHESLRNEANSPKNVLEQVKYRAEWLKYQEQQKAKEEELLERERVAYAQIDWHEFVVVETVDYQPFEIGNFPAPTTPEEVGARILIQERIEEGEDIEMQLESDEEEPPVTEAGLSSMQDKTNRKTRDDTRIQDMEEESSDEEKEEEEELALPPPPPSIQPPLPPIPDKVVVKKYDPKQAVNVSRPTIGDDYLVSPITGEKIPANKVQEHMRIGLLDPRWVEQRDKQITDKMNQETVYAAGSAIDASLKLLAERRTDIFGVGDEETAIGKKIGEEDVRKDEKVTWDGHTSSVEAATRAARANITLEEQIHQIHKVKGLLPDEEKEKIGPKNIGSKSGKINIQSVITTKPPTSLQPKPPVSLIQTQATASLISVPPQPMLPPQPPIMMMSATSMPPIRPPPIMMTGPPPIPGFPVAPMSSPMGPPMNLPPMKHQAEAPHEDEPSNKKMRNEDSLIPEKVFLARHQSQVAIKISIPHMPEKSEWKLTGKMISWTVPLAESVANLKAKLQEETNMPPAKQKLFFDGMFFKDSNSLAYYNVTTGSIIQLQIKERGGRKK

SEQ ID NO: 11249 - protein, 322 aa, Diabrotica barberi; identical to SEQ ID NO: 11025

SEQ ID NO: 11250 - protein, 529 aa, Diabrotica barberi
MFGGGRAPILVLSQNTKRESGRKVQLENINAGKQIADVIRTCLGPQAMLKMLMDPMGGIVMTNDGNAILREITVQHPAAKSMIEIARTQDEEVGDGTTSVIVLAGEMLVAAEQFLEQHIHPTIIIRQYRQALEDMIQLLEGPLSIPVDRNDKNALAQVVKGCIGTKFISKWSDLAVNIALDAVNTVLLEENGRTEVDIKRYAKVEKIPGGSIEESKILRGVMLNKDVTHPKMKRYIQNPRIILLDCALEYKKGESQTNVEISAETDFTKLLELEEEHVKRQCDEIIALKPDVVFTEKGVSDLAQHFLLKAGITAIRRVRKSDNNRIARACGATIVNRTEELQESDVGLGAGLFEIKKFGDEYFCFVVECKNPKACTILLRGASKDILNETERNLQDALQVARNIVLSPRLVPGGGAVEMAVAQRLMQKATHGPYRALAHALEIIPKTLTQNCGANTIRTLTALRAKHANHTDVNKPCLWGIDGETGELVEMDKKELWEPLAVKLQTYKTAIETAILLLRIDDIVSGSKK

SEQ ID NO: 11251 - protein, 233 aa, Diabrotica barberi; identical to SEQ ID NO: 11027

SEQ ID NO: 11252 - protein, 298 aa, Diabrotica barberi
MFQFGFNMFPEVPRPFNMTYKCYSVAMFPGNEREDVERGGKIIMPPSALEQLTRLNINYPMLFKLVNKKTHRTTHCGVLEFVADEGKVYLPLWMMNNLVLTEGDLVQMESVSLPVGTFSKFQPLNPDFLDITNPKAVLENGLRSFACLTTGDVIAVKYNQKAYELCVLETKPGDAISIIECDMNVEFAAPVGYKEPEQVKKEEEEMAIDPADLMPEPSGFVAFRGAGNRLDGKKRKDTSGADSSVGKPTYVRGIPDYDYQIGNLTFIRRMIKQKSNDYAEDSEFKAFSGAGFSLKSRT

SEQ ID NO: 11253 - protein, 540 aa, Diabrotica barberi
MSAIPGSIAFDEYGRPFIILRDQDKQKRLTGVDALKSHILAARQIAQTISTSLGPKGLDKMMVSPDGEVTVTNDGATILKMMDVEHEVAKLLVQLSQSQDDEIGDGTTGVVVLAGALLEQAGSLLDRGIHPIRIADGFELACQTAVAHLEKIAELFPVSAENTEPLIKVAMTTLGSKIINKCHKQMAEIAVNAVLAVADLEQKDVNFELIKVEGKVGGKLEDTTLVKGVVIDKTMSHPQMPKELKDVKLAILTCPFEPPKPKTKHKLDVSSVEDYKELRQYEQEKFKEIVGLVKKAGATLAICQWGFDDEANHLLLQQELPAVRWVGGPEIELIAIATGGRIVPRFEELTPEKLGHAGLVREIAFGTTKDRMLVIEECSNSRAVTILVRGGNQMLVAEAKRSLHDALCVVRSLVQEPRVVYGGGAAEIACSLAVAAQADQLASLEQYAYRAFAEALESIPLALADNSGLSAIHTLGEVKAKQAATGDPALGIDCMNTGNLNMREQHVIESLRSKRQQFLLATQLVKMILKIDDVRQPASG

SEQ ID NO: 11254 - protein, 113 aa, Diabrotica barberi; identical to SEQ ID NO: 11030

SEQ ID NO: 11255 - protein, 534 aa, Diabrotica barberi; identical to SEQ ID NO: 11031

SEQ ID NO: 11256 - protein, 283 aa, Diabrotica barberi
MFRNQYDSDVTVWSPQGRLHQVEYAMEAVNLGSATVGLKSKTHAVLIALKRASSELSAYQKKIINIDDHIGITISGLTADARILSRYMRNECLNYKYSLDTYMPLNRLISILGNKMQTCTQRYDRRPFGVGLLVAGYDESGSHIYQTCPSANFYDCKAMSIGARSQSARTYLEKHLDELPSSSLEELIKHGLRALRDTLPPEVDLTTKNVSIGYTGKGVTFKILEEEETAPYLSLIEGEERRGGGAAAAAIEDLPADPLRDDAGDEPRDAVPAVEMSAMDTTE

SEQ ID NO: 11257 - protein, 848 aa, Diabrotica barberi
MPIKPGHETENIEITFSDEDLPYEEEILRNPYSVKHWLRYIDHKKTAPNNGVNIIFERALKELPGSYKLWYNYLRTRRNQIKSKCITDPGYEEVNNAFERSLVFMHKMPRIWMDYCTFLTDQCKITRTRKVFDRALRALPVTQHNRIWPLYLKFVQKHDIPETAVRVFRRYMKLCPENAEEFIDYLTGIERLDEAAQLMAKIVNDEGFVSQQGKSKHQLWNELCELISKNPEKVHSLNVDAIIRGGLRRYTDQLGHLWNSLANYYVRSGLFERARDMYEEAIQTVTTVRDFTQVFDAYAQFEELSLSKRMEEVANKSSPTEDDDTELELRLARYEYLMERRLLLLNSVLLRQNPHNVQEWHKRVQLYEGKPVDIINTYTEAVQTVDPKLAVGKLHTLWVDFAKFYETNGQIEDSRLIFEKASQVSYVKVDDLATVWCEWAEMEIRNENYDEALRLMHKATFMPSRKVAYHDDTETVQSRLYKSLKVWSMYADLEESFGTFKSCKAIYDKIIDLKIATPQIIINYGIFLEENNYFEEAFRAYEKGISLFKWPNVYDIWNTYLTKFLTRYGGSKLERARDLFEQCLDGCPQQFAKHLYLLYAKLEEEHGMARHAMAVYERSTKAVPEQEMFDVFNIYIKRAAEIYGIPKTRQIYEKAIEVLPEDKTREMCLRFSDVETKLGEIDRARAIYAHCSQICDPRITAEFWQIWKEFEVRHGNEDTMREMLRIKRSVQAVYNTQVNMMSAQMLSSAGSMSGTVADLAPGVKDGMRLLEAKAVEMAGTSQVAKPGGIMFVRGETQGANKDKVVNPDEIDIDSEESEAEEEVPVEKQNVPSEVFGSLKKQGQGVDDD

SEQ ID NO: 11258 - protein, 391 aa, Diabrotica barberi
MANGPIAERNRDATIYVGGLDDKVSESLLWELFVQAGPLVNVHMPKDRVTTMHQGYGFVEFMGEEDADYAIKIMNMIKLYGKPIRVNKASAHQKNLDVGANIFIGNLDPEVDEKLLYDTFSAFGVILQTPKIMRDPDTGNSKGFAFINFASFEASDASIEAMNGQYLCNRPISVSYAFKKDSKGERHGSAAERLLAAQNPLSQADRPHQLFADAPPIGLMPMSMAPPPPPVIMTGMMPPPPPTLSNLPPPPPPVPPPGMGSSFPAGIPPPPLPPSQPPLPPGAPPTMPTAAGAQARPPLPPPPVAPHGLIPPPPTWTGAAPGSLPIPPGPPAPAGGAAFGGMFPPPPPPGGRPPPPNWRPPPPPPPGFAGSRPAFPVRGPPPPPPTFDTKI

SEQ ID NO: 11259 - protein, 257 aa, Diabrotica barberi; identical to SEQ ID NO: 11035

SEQ ID NO: 11260 - protein, 138 aa, Diabrotica barberi
EIMARTKQTARKSTGGKAPRKQLATKAARKSAPATGGVKKPHRYRPGTVALREIRRYQKSTELLIRKLPFQRLVREIAQDFKTDLRFQSSAVMALQEASEAYLVGLFEDTNLCAIHAKRVTIMPKDIQLARRIRGERA

SEQ ID NO: 11261 - protein, 530 aa, Diabrotica barberi
MAISLLNPKAEVARAAQALAVNISAAKGIQDVMKSNLGPKGTVKMLVSGAGDIKITKDGNVLLHEMQIQHPTASLIARASTAQDDMTGDGTTSTVLVIGELLKQADIYIAEGLHPRLLTDGFDKARTKALEVLEKMKIPVEANKETLTDICRTSLRTKLHQKLADVLTDVCVDAVLAIKKDDKPVDLHMVELMEMQHKTETDTQLIKGLVLDHGSRHPDMPKSLNNCYILTCNVSMEYEKSEVNSGFFYKTAEEREKLVTAEREFIEQRVKKVIELKRSLCNGTDKTFVIINQKGIDPMSLDMLAKEGIIALRRAKRRNMERLSLACGGVAMNSFDDLQESQLGRAGHVYEHVLGENKYTFVEDCKIPQSVTILIKGPNKHTLTQIKDAVRDGLRAINNAIDDKAVIPGAGAFEVTANKELLAFKDTVKGKARLGVAAYAEALLVVPKTLAVNSGFDAQDTILKLQEESRLNPDPIGLDLTSGEPINPKDAGIYDNYIVKKQIINSCSVIASNLLLVDEIMRAGMSSLKG

SEQ ID NO: 11262 - protein, 1094 aa, Diabrotica barberi
MSSGSLADNSIDPPAKKRKLESKIATLEMANNEASGSSTSDIDEGLYSRQLYVLGHEAMRRMANSDVLISGLGGLGVEVAKNVILGGVKSVTLHDEALCTIKDLSSQFYLTEGDIGKNRAEACCKQLSELNTYVPTKSYTGPLDEAFILKFSAVVLTTSNREEQLRISEITHDNNIALIIADTKGLFGQVFCDFGKSFTVVDVNGEPLVSAMIADISNDVESVVTCIDDTRHGMEDGDYVTFSEVLGMTELNNCEPIKIKVLGPYTFSIGDTTKFSKYTRGGIVSQVKMPKHLEFKSFKDSLENPEIPITDFSKMDFPTQLHLAFTTLHKFVEKSGRLPKPWNNDDATEFVNLAKSLAAKGDSEAEVNVDLLDTFAKVSAGDLNPINATIGGIVAQEVMKACSGKFHPIFQWFYYDAIECLPQDKSEITEELAAPTGSRYDGQVAVFGKEFQKKIASLKYFIVGAGAIGCELLKNFAMMGVGTQGEVTVTDMDLIEKSNLNRQFLFRPHNVQQPKSATAAKAIKKMNPDINVVAHENRVGPETESVYNDDFFEKLDGVANALDNVDARIYMDRRCVYYRKPLLESGTLGTKGNTQVVAPFLSESYSSSQDPPEKSIPICTLKNFPNAIEHTLQWARDMFEGLFKQNAENASLYITDPDFLDRTVKLPGVQPLEVLESVKAALIDERPKDLNDCIAWARNHWQEQYSNQIRQLLFNFPPDQLTSTGQLFWSGPKRCPEALTFDVNDPLHLDYVIAAANLKAEVYGIPTSRNREQIAEVVMQVNVPEFIPKSGVKIAVTDSQMAMNGNNVDLDRVSQIKEELPSVAELGGLRLTPLEFEKDDDTNFHMDFIVAASNLRAANYKIPPADRHKSKLIAGKIIPAIATTTSVVAGMVCLELYKLTRSYTSLTPFKNNFINLALPFFSCSEPIAAQQMEYCGNKWTLWDRFDVQGEMTLSEFLEYFKEKHGLEITNLALPFFSCSEPIAAQQMEYCGNKWTLWDRFDVQGEMTLSEFLEYFKEKHGLEITMLSQGVCMLYSFFMAKAKAQERFGLSMSEVVRRVSKKKIEPHVKALVFELCCNDSTGEDVEVPYVKYNLC

SEQ ID NO: 11263 - protein, 336 aa, Diabrotica barberi
MADADDLLDYEDEEQTEQTATETATTEVQKKGVKGTYVSIHSSGFRDFLLKPAILRAIVDCGFEHPSEVQHECIPQAVIGMDILCQAKSGMGKTAVFVLATLQVIDPTENVVYVLVMCHTRELAFQISKEYERFSKYMPNIKVGVFFGGLPIQKDEETLKNNCPHIVVGTPGRILALVRSKKLNLKHLKHFILDECDKMLELLDMRRDVQEIYRNTPHEKQVMMFSATLSKEIRPVCKKFMQDPMEVYVDDEAKLTLHGLQQHYVKLKENEKNKKLFELLDVLEFNQVVIFVKSVQRCVALAQLLTEQNFPAIGIHRGMDQKERLSRYEQFKDFQK

SEQ ID NO: 11264 - protein, 489 aa, Diabrotica barberi
MVTLEDVEMKNADSPPGLEAGDTKKDTDLQSVIEIREHARQIEKSVTSKENRFILRVLRCLPNTRRKLNGLVLRSLITQIYPVAERDALISFVEEASGELDATQSRARSAVKSPVPEVDTYINLLILVRLIDTNKLVEAERCSQALMNKITNQNRRTIDHIAAKCYFYHSRVAELTNKLDSIRGFLHSRLRTATLRNDFEGQAVLINCLLRNYLHYSLYDQADKLVSKCVFPETASNNEWARFLYYLGRIKAARLEYSVAHKHLVQALRKAPQNAAIGFRQVVQKLTVVVELLLGDIPERQIFRQSSMRHSLAPYFQLTQAVRMGNLQRFGEVLENFGPQFRQDHTFTLILRLRHNVIKTAIRSIGLSYSRISPQDIAKKLGLDSAEDAEFIVAKAIRDGVIEATLDPQGGYMRSKESTDIYCTKEPQLAFHQRISFCLDLHNQSVKAMRYPPKAYGKELESAEERREREQQDLELAKEMAEEDDDGFP

SEQ ID NO: 11265 - protein, 555 aa, Diabrotica barberi
MATNHQNLPISSILKSKSEVDDEPKKKSREDWRKAKELEEARKAGTAPAAVDEEGKDINPHIPQYISNAPWYYGTSGPTLKHQRPQEEKQKEYSNIDEWYKRGVDTSKIVTKYRKGACENCGAMTHKKKDCMERPRKVGAKFSGANIAPDEFAQKNLALSFDGKRDRWSGYDPSEHKAVIEEFQKVEEAKRQLKADKLNANESSDDEEKDEDKYVDEVDMPGTKVDSKQRITVRNLRIREDTAKYLRNLDLGSAYYDPKTRSMRENPNPEKDATYSGENFVRFTGDTTNHAKAQLFAWEAYEKGVDVHLLAEPTKLELLKKEYEKKKEEVKSTIQSSVLDKYGGQEHLEAPPKSLLLAQSEVYVEYSRSGKVITGAEKEVIRSKYEEDVYINNHTSVWGSYWRGGQWGYKCCHSFIKNSYCLGEAGKTVNAPVTQDIPKDQDVGEASSTKEAGISDGESEDSSSSNSSEGEKLKKKQRRLKKKEKKAKKKEKKAKEKLKKKQEKEKAPEIDEEIMLDDRKRPYNSMFDAKKPTEEEMEEYYKKRKRDEDPMNNFM

SEQ ID NO: 11266 - protein, 238 aa, Diabrotica barberi
YLRLDVLIRTSSSYGEASSCLLWILVYSFRMGISRDHWHKRRSTGGKRKPLRKKRKFELGRPAANTKLGARRIHYVRTRGGNLKYRALRIEKGNFAWGSEGTARQTRIIDVVYNASNNELVRTKTLVKNAIVVIDATPFRQWYESHYILPLGRKKGAKLTADDEEIFNKKRSKKVQKKYETRQKTAKVEPALEEQFSTGRLLACLASRPGQCGRADGYVLEGKELEFYIRKIKSKKAK

SEQ ID NO: 11267 - protein, 311 aa, Diabrotica barberi; identical to SEQ ID NO: 11043

SEQ ID NO: 11268 - protein, 365 aa, Diabrotica barberi
MTVINKMEVDGGPKGEGFRSYYITKIEELQLIVAEKSQNLRRLQAQRNELNAKVRMLREELMLLQEQGSYVGEVVKPMDKKKVLVKVHPEGKFVVDIDKNIDINDVTPNCRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILKIHSRKMNLTRGINLRKIAELMPGASGAEVKGVQTRKN

SEQ ID NO: 11269 - protein, 199 aa, Diabrotica barberi
MVKIYCLSVLYKGPTTATWLKSAFELQSFSFFQRGSIQEFMSFFCKTIVERTIPASRQSVKEGEYLCHVYVRADNLAGVIITDHEYPSRVSHTLITKILDEFGAKIPAANWPNLEERDVAFPQLNTYLAKYQNPREADAITKIQEDLDETKIILHNTIQAVLERGEKLDDLVSKSEGLSIQSKAFYKTARKTNSCCSFT

SEQ ID NO: 11270 - protein, 201 aa, Diabrotica barberi
TSGGVVLAVEKRITSPLMEPTTIEKIVEVDKHIGCAVSGLMADSRTMIDRARVECQNHWFVYNENISVESCAQGVSNLAIQFGDSDEDGAAMSRPFGVAILFAGIDEKGPQLYHMDPSGTFVQFDAKAIGSGSEGAQQSLQEAYHRSMTLEEATTTALTILKQVMEEKLNSSNVEVMTMTPKDMFHMFTKEQVEEVIAKLS

SEQ ID NO: 11271 - protein, 309 aa, Diabrotica barberi
MKMGVQVLITDPNQLEAIRTRELDITKERIQKILSTGVNVILASGGIDDLCLKYFVENGAMGVRRVKKADLKRIAKATGATFLTSLSNMEGDESFDSSMVGEAAEVVQERISDDELIIIKGPKARTAASIILRGPNDFYCDEMERSVHDALSVVKRVLESKSVVVGGGSVEAALSIYLENFATTLSSREQLAIAEFARSLLVIPKTLAVNAAQDATDLVAKLRAYHNSSQTKKDHAHLKYVGLDLMEGTVRDNRKAGVLEPTMSKIKSLKFATEAAITILRIDDMIKLDSEQRGGKSYQQAMDSGELYD

SEQ ID NO: 11272 - protein, 330 aa, Diabrotica barberi
MFNSAAPPLWHNGPVPGEFYNFPGKQTSYSNPITHTQSPVTTSTSVLAITYDKGVLIAGDLVASYGSLARYRNCPRVIKVNQNIILGAGGDYADFQYVKSFIEQKIIDEECIDDGLKMKPKSLYCWLTRVMYQRRSKLDPFWNNLVIGGIQDGVPFLGTVDKLGTAYTDKVICTGYGAHIALPLLRDSLDKNGALNLADAKTLIHKCMEVLFYRDARSFPKYQLGVIDKDDGVTIQGTIDKLGTAYTDKVICTGYGAHIALPLLRDSLDKNGALNLADAKTLIHKCMEVLFYRDARSFPKYQLGVIDKDDGVSIEGPISVEENWSIAHMT

SEQ ID NO: 11273 - protein, 565 aa, Diabrotica barberi
VEGCKELLEVPGRKFLYEGDLLEIDPTENTSLKTVHVYLFTDGFMITNRNSNSRGLMKYIYEIMYDLSSLAVVNVRDLGNVKHAFKLLIFPDTRVFQCSSNSNKKEWLDKFDQAKKTRLAQEQHKRESISEKSPSRSASIESPSYNPFDEVEDDVGMVHPEWFLDIPEELDVCVAQRHFEEALSLLQKAKEYISQMTAGNEKHDHVFLDIQRKVEQRQNSLTEVLMKELEVNPDKSLQGGLRAARRAVRLLNQLGRENQSCNLFLKLCSSMLRTQCKRVKREGSTTTYIRNLASVVFTNMCHMSDEFLRAFPDSPTCASAYVVWASNELLLFTGHFIKQVFMPQTSLSTVTECIVLVRTQCERLYSYGLDLCYQLDGALRSSLVKALKDARDKLIDSIKLRALEDKWIPINLHSKSALGRFLHEHSQMGLNLESYVSGDTWIQLTASTLSFTKMFFQLLNDCMKLKTTELVYTIDETLYNVFDAQLKHNENALRNELNQDQRSFLTKNAEFLLVNVVEVSQKIYSQNVGYECATLKKLQGEYVALKKGVSPTTRSTKTKYSSEFL

SEQ ID NO: 11274 - protein, 1034 aa, Diabrotica barberi
MDELQKLEYLSLVSKVCTELENHLGMNDKDLAEFIIHLSEKNGTFESFKKALIENGAEFSDSFISNLLRIIQHMKPKKNKSKVEADVYQKESLATKFPGLALPNEKQKPLFIDEEAPAEKNEDDDIVADLMKQFEADAPSNSQIQTTTKSGSASPIERKRSSRSRSRSKPRKIRKSRSRDRDSRKDKRRSRSRDQKKNRRDRSGSRSKRNKERSRSRNRRSRSRDRRSRSRDRRNRSKDRKYKNYSRDKDRRERSNSRDIKRDRSTEKKFKSEKDNPEFEDDPNPGKIYNGKVSNIVPFGCFVQLEGLKRRWEGLVHISQLRAEGRVTNVSEVTSRGARVKVKVLTVTGQKVSLSMKDVCQITGKDLNPHSHAPTEREDRDRNPDRPVNSSTSVLRLPVNIDEGEEDSRKRVTRISSPERWEIKQMISSGCIAKSELPDFDEETGLLPKDEDGEADIEIELVEDEAPFLQGHGRALHDLSPVRIVKNPDGSLAQAAMMQSALAKERREQKMIQREQEVDSQPSGKNKSWIDPLPEDESRMMGRGIGLQVQDLPEWKKHVIGGKKSSFGKKTNLTIIEQRQSLPIYKLKEELRKAVTDNQILIVIGETGSGKTTQITQYLAEAGFTSRGKIGCTQPRRVAAMSVAKRVAEEFGCRLGQEVGYTIRFEDCTSPETMIKYMTDGMLLRECLMDLDLKQYSVIMLDEAHERTIHTDVLFGLLKQAVMKREELKLIVTSATLDAVKFSQYFFKAPIFTIPGRTFPVEVLYTKEPETDYLDASLITVMQIHLREPPGDILLFLTGQEEIDTACEILYERMKSLGPDVPELIILPVYSALPSEMQTRIFEPAPPGSRKVVIATNIAETSLTIDGIYYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLSKMLIMSVALQCSDEILTIVSMLSVQNV

SEQ ID NO: 11275 - protein, 415 aa, Diabrotica barberi
MSSKRKSKESIIARVNFPLYTLQMLTSRHVIVGGGGGTSKTGVHNGFEIFEIFHDGTRFAAKEVTRHETGGNVVMNCSVYSDRKYSLLVAGQESECQLYKLNPKLVEEVENIGNNTHLRQRNTKNKEVTDDNKNVTKELYFDVNAIENVQTDFNGSEPLSRVVKINHDGTLLATGGTDGDVRIWKFPSMQPLFILKAHTKEIDDIDFSRYDNYVITIAKDGLAVLWDCMTGKERTKLTWKQPEGSKYLYKRCRFGVIEGLDKKCALYTISNPIGVAKKQKSYLQQWIPEENMLRRCIEFDESLAALAVRDDGRFVAVGTMFSGSVSILVAFNLQKILTIVGAHSMFVTGLEFLPTQNLNHSISSVVEAAVLSISVDNQLCIHTVPYRKTIPLWIAIALLVLTLFLTFLLCSYLGL

SEQ ID NO: 11276 - protein, 413 aa, Diabrotica barberi; identical to SEQ ID NO: 11052

SEQ ID NO: 11277 - protein, 588 aa, Diabrotica barberi
MASKSKKGSTPLASQRPASPLSPTRHSRLQEKHELQNLNDRLAGYIDRVRYLEGENNRLTREIQTTQETVTREVSNIKSMYDHELSDARKLLDETHREKARLEIDVKRLLEENDELKSELAKKNKDLALAENSARIYETRCNELQLKANQAAADAKKAIADAKELEKERDKLRKLLDNHRKQLEEESLARVEVENANQSLREELSFKDQIHQQQLTETRTRRQVEISEIDGRLAEKYEAKLQEALQELRDQYESQMANNRGEIELLYEQKIKNLQSANDRHSASASGALDELRQVRTRIDTLNSRISDLENQNAGLAARARDLEKLLENERMRHVEDLAMLERELHRLREEMANQLQEYQDLMDIKVSLDLEIAAYRKLLESEEARLNITPTGSEVHEVTHSRSQRSSSQRRTPVRLGAKRKRTLLEESQESSMNDYSVNSSSKGDIEVADVDPEGHYVKLHNKSNQEVALGGWQVIRRVGEEETTFKFHRSLKLEGNGYVTIWSSDLNKDHEPPTNLVMKSQKWVVGDNMVTTLLNNNGDEVAVSERVKRQLTSSHLRHRELAAGYLSEELHHQQGDPQVDERCRLM

SEQ ID NO: 11278 - protein, 684 aa, Diabrotica barberi
EDLATAILRKKDRPNRLLVEEAVNDDNSVVALSQAKMDELQLFRGDTVLLKGKRRKETVCIVLSDDTCSDEKIRMNRNVRNNLRVRLSDVVSIQACPDVKYGKRIHVLPIDDTVEGLTGNLFEVYLKPYFLEAYRPIHKDDVFVVRGGMRAVEFKVVETDPAPYCIVAPDTVIHCDGDPIKREEEEDGGMRAVEFKVVETDPAPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSEAALQQIREKMDLIDLEDDQIDAEVLNSLAVTMENFRYAMTKSSPSALRETIVEVPNVTWDDIGGLANVKKELQELVQYPVEHPDKFLKFGMQPSRGVLFYGPPGCGKTLLAKAIANECQANFISVKGPELLTMWFGESEANVRDIFDKARSAAPCVLFFDELDSIAKSRGGNVGDAGGAADRVINQILTEMDGMGAKKKRVYYRCYKQTRYHRSCNIASRSSRSVDLHPSARREI

SEQ ID NO: 11279 - protein, 274 aa, Diabrotica barberi; identical to SEQ ID NO: 11055

SEQ ID NO: 11280 - protein, 1334 aa, Diabrotica barberi
MERPPRNEPTVEPVNGVVQPLVQPPPESPGRVTNQLQFLQKTVLKAVWKHQFAWPFQQPVDARKLNLPDYHRIIKQPMDLGTIKKRLDNNYYWSGKECIQDFNTMFTNCYVYNKPGEDVVVMAQTLEKVFLTKVADMPKEEFVVESPGKAGAAKGKKGRTSTAGAASAPPTPTTATAGSGGRGRPPATVSSTSATPVATTTGSSGLPLGTQAPATVPGSTATTTIAAASTNNSSLSNQQLNSSSSSIHGSGSSIGNSLDSSSVMPANVIPPAQPAKVKKGVKRKADTTTPATAYDYPPTLESKSAKISTRRESGRQIKKPTRPELDGHPPQPPPLKPKEKLPESLKACNEILLELFSKKHSSYAWPFYQPVDAELLGLHDYHDIIKKPMDFSTVKNKMENREYRTPQDFAADVRLIFSNCYKYNPSDHDVVAMARKLQDVFEVKYAKIPDEPVNRVGAPAVNNIPAKSETSTSGSSSDSSSDTEDSEEERRNKQLKLLEKELTAMQEKMRKLVDESSKKKKEKKKDKVKKKPASGGSMANASLSTLPNSSSAGLGKPGAGGHGALNKSNNNNSIAADSVDDSIASVVSGADLKMAESHHPQTGTGAHHPPAGKSLNMHHNMTANAGANASAQAKTPKSKGLRGNKPAAATNAAPNKRVKANNKAGAGRKKNAAQPPPMQFDSEDEDNAKPMSYDEKRQLSLDINKLPGDKLGRVVHIIQSREPSLRDSNPDEIEIDFETLKPSTLRELESYVASCLRKKPHKKVAGKSKDEQIAEKKQELEKRLIDVNDKIGNSKKAPKKDEANKVDPTGAGGPSGRLSSSSSSSDSDSSSSSLSSSSSDSSDSEAGGTANRQAKKKANKKSPNPSLGSSATTTTIKVPPPQTTATPAPPSQAAPAITTAATANLTTTVTVPPLTTTTTSTIAPPIQPAPVPNVVVPAQTTPAAPAFTPSITVKPSLQAAPIAPTVPPLIKSIEKLPVTTLLPPTVPTITPPTIEKLPVTTLLPPTVPTITPPTVPQAPKSVALPTPSPDKPKPNIISPIGTFTDPIEQSLASLEHDIKQNDPMDVITASTMMQMPTTLTNPIVSHPHPNLNLNPTINHPILQPSTLSMDLKAPIMGTMAPSNTMLHHGLQQAMETDISIPPPPTNMLHGQNNGFGMKHNFDLTTNNNGLSSMGLPMEMSISSMFDPIPQNINPMMKNDSQLKMDDRMDTLGGLLNDKKSNLLIQKPMSQSFGFKNDKPDHNVKNASSWSSLAKGKSPQNNIPGGSSKQQVMDSFKAFQNKAKEKADREKQRLENLEMKRQQREQAERERLRAENERRREREEEDALEKARKAV

SEQ ID NO: 11281 - protein, 407 aa, Diabrotica barberi
MSLSTARPLVSVYNEKSEEVKGSNISLPAVFKAPIRPDVVNFVHQQVSMNHRQPYSVSDKAGHQTSAESWGTGRAVARIPRVRGGGTHRSGQGAFGNMCRGGRMFAPTKPWRRWHRRVNINQRRYALASAVAASGVPALVMSKGHVIDQIPELPLVVSDKVQEMSKTKQAVQFLRRIKAWADIQKVYKSQRFRAGKGKMRNRRRIQRKGPLVVYYKDQGLRRAFRNIPGIDLISVQKLNLLKLAPGGHVGRFVIWTESAFQRLDKLFGTWKTASLEKKGYNLPQPKMANTDLSRLLKADEIKAVLRAPQKKVVRRVRRLNPLTNAKAMLKLNPYAAVLKREAILKNQKRQLNREELLAKKRGITLSADNVVIRSRKLQERRRAQILKDKKSKPKKAKKAPAKATGKK

SEQ ID NO: 11282 - protein, 1902 aa, Diabrotica barberi
MADFINSEAEESSEEEELDHRDRKKAQKAKVVDSSDEDDEDDDERLREELKDLIDDNPIEESDAESDASGREKRKKSDDEDLDDRLEDEDYDLLEENLGVKVERRKFKRLRRFEDEESEGEEEHDPEQDREQIAMDIFSDDDDERRSERSHRPAVEQETYGVGEEEEEGEYSDADDFIVDDDGRPIAEKKKKKKPIFTDAALQEAQETFGVDFDYDEFSKYDEDDYEDEEEEDDEYEEDDVEKRKRPKKTSKKKPTKKSIFEVYEPSELKRGFFTDLDNEIRNTDIPERMQLRDVPITAVPDDSTELDDEAEWIYRQAFCNRTVSNVDSHLSSEAREKLKKTHHAIGKIRKALDFIRNQQLEVPFIAFYRKEYVQPELNINDLWKVYKYDAKWCQLKTRKENLLKLFEKMRSYQTDHIMKDPDAPIPDNLRIMTESDIERLKNVQTAEELNDVHNHFVLYYAADLPAMHAAWRVKERERRRQERKEARLKLIAESEEGAEIPEEPEEIDDDEPEAETLKYANRSGSYALCNKGGLGPLAKKFGLTPEEFAENLRDNYQRHEVDQEHIEPVEVAKEFVSPKFPTVEEVLQATKHMVALQIAREPLVRKCVREIFFERARLNVYPTKKGVKVIDEAHNCYSMKYVKNKPVRDLAGDQFLKLCLAEEENLLTITINDHIQGNTTNNYIDEVKQLYIKDEFSKHVQDWNALRMESVERALTKSVLPDLRSELKRTLLTEAKEFVLKACCRKLYNWIKIAPYAITFPDEDEDDWDTSKGVRTMGVAYVPEHTVSAFTCISAPDGDITDYLRLPNILKRKNSFRTEEKLMKEADLQALKNFIFLKKPHVIAVGGESREALMIADDIRALKKPHVIAVGGESREALMIADDIRGVISELIESDQFPQIRVEIIDNELAKVYANSIKGSTDFRDYPELLRQAISLARRMQDPLVEFSQLCNSDEEILSLRFHPLQEQVQKEELLEALCLEFVNRTNEVGVDINLAVQQIHKSSLVQFICGLGPRKGQALLKVLKQTNQRLENRTQLVTFCHMGPKVFINCSGFIKIDTNSLGDSTEAYVEILDGSRVHPETYEWARKMAVDALEYDDDEGANPAGALEEILEAPERLKDLDLDAFAEELERQGFGNKSITLYDIRAELNSRYKDLRQTFRSANPEELFDMLTKETPETFYIGKMVTSTVFGIARRKPKSDQLDQANPVRNDETGLWQCPFCLKNDFPELSDVWNHFDAGACPGQATGVKLRLDNGILGYIYIKNISDKPVANPEERVGIGQLIHCRIIKIDVEKFSVDCTSKSSDLADKNHEWRPQRDPHYDQEREDKDNRLEAEKKKEKQRMTYIKRVIVHPAFHNISYAEAEKCMVNMDQGEVIIRPSSKGADHLTITWKVTDGIYQHIDIKEQGKVNAFSLGKSLWIGNEEFEDLDEIIARHVTPMAAHARDLLYFRYYKDFQGGHKDKAEEYLKDEKKKNASKIHYVVSAAKNIPGKFLLSYLPRNKVRHEYVTVTPEGFRFRQQMFDSVASLFKWFKEHFREPPPGGATPGSTPRMASSRTGYGSATPAYSMNNEAIQRVAQNLPSHVVQALSAATNQTPHYPHTPGYGGNYINTPYTPSGQTPYMTPYATPHTQQTPRYGHQTPSQHMASSAPQGLNNPFLHPGAVTPSQRTPSYRNHPAQSPMLPTSPVPSPGSQSSYSSHLSHNQRSGSYAESLRFQPPESPRSLVSYRNHPAQSPMLPTSPVPSPGSQSSYSSHLSHNQRSGSYAESLRFQPPESPRSLVSNRSFQTDRYGGDRYGKGGSHRYGGSSNEDRYGKGGGGNENTDWQKAAEAWARSRSTPRSDGRNTPRSVGQRTPRYDNDAERSRMKHLSKSPRSVRSTPRTNTSPHSMSLGDATPLYDESI

SEQ ID NO: 11283 - protein, 815 aa, Diabrotica barberi
MPDTKDANLSSPERKRRKKSRSKSPERKEKKSSKKKAHNSRDRDSSEEGYNPKDYQRYYGEDRPNSDKYWNKYPRKDNTKVGQRYYDAAPEESGKKGPDRNSEEKELPKPVEPVPDKSVIKPRERKTVDMLTSRTGGAYIPPAKLRLLQASITDKTSAAYQRIAWEALKKSVHGYINKINTSNIGIIARELLHENIVRGRGLLCKSIIQAQAASPTFTNVYAALVAVINSKFPSIGELLLKRLVLQFKRGFKQNNKSICISATTFVAHLVNQRVAHEILALEILTLLVETPTDDSVEVAISFLKECGQKLTEVSSRGITAIFEMLRNILHEGQLEKRIQYMIEVMFQIRKDGFKDHAAVVEELDLVEEEDQFTHLIMLDDVKEADAEDILNVFKFDESYEENEDKYKTLSKEILGSDGESESGSEGSEEESDDENEEEVKDQGTIIDNTETNLISLRRTIYLTIQSSLDFEECAHKLLKMELKPGQEIELCHMFLDCCAEQRTYEKFYGLLAQRFCQINKVYIEPFQQIFKDTYSTTHRLDANRLRNVSKFFAHLLFTDAIGWEVLDIMKLNEEDTNSSSRIFIKILFQELAEYMGLGKLNARLKDETLQAYFSGLFPRDNPKNTRFSINFFTSIGLGGLTDELREHLKNIPKMMEMKLATKEKANSGSSSSESSSEEDSSDDSSEDSSSSEDDRGKKKKKTKKLEEKNSKVNSKSRPRSKEKEHADKPRDKHRKEDRHKSDKNPDRSSSKKYSKEDNKRKKDYEWMKSRYEDDIKQLKNDKRVFEKSSKRRSRSRERVKVKEERRRRSRERRRS

SEQ ID NO: 11284 - protein, 624 aa, Diabrotica barberi
MALKNQVGQKIMNEVIKHKPTKKNGPTPGQQPHGVEWRILVVDQLAMRMVSACCKMHDISAEGITLVEDIMKKREPLGTMEAVYLITPSEKSVHALMNDFEPPRQMYRGAHVFFTEVCPEELFNEPLMNDFEPPRQMYRGAHVFFTEACPDQLFSTLCHHPVAKFIKTLKEINIAFIPTESQVFSLDSPDTFQCSYDPSFSAARNANMERMAEQIATLCATLGEYPHVRYRTDWERNVELAQLIQQKLDAYKADEPTMGEGPEKARSQLIILDRGFDCVSPLLHELTFQAMAYDLLPIENDVYKYEASAGVMKEVLLDENDELWVDLRHQHIAVVSQSVTKNLKKFTDSKRMTQSDKQSMKDLSTMIKKMPQYQKELSKYATHLHLAEDCMKAYQGYIDKLCKVEQDLAMGTDAEGEKIKDHMRNIVPILLDPKITNEYDKMRIIALYAMTKNGITDENLSKLATHAQIKDKQTIANLQLLGVNVINDGGPRKKQYTVPRKERITEQTYQMSRWTPIIKDIMEDCIDDKLDQKHYPYLSGRAQSTGYHAAPSSARYGQWHKDRGQQAVKNVPRLLVFVVGGISFSEIRCAYEVTNAQKNWEVIIGSSHILTPEDFLSNLATLAG

SEQ ID NO: 11285 - protein, 712 aa, Diabrotica barberi
MMQQYMKELEQEPFDAEEFVERLAWRTLAESKGDGEEHEINPALLHESFVQAIKDLNLLHERQQKKCEKLEVVVREDEATFFQEIYNLLEQNKQAMDTFQELDGKINHVATKVLHLGDQLDSVNGPRSRVVDALKLMIHLTEFLSEESVLSPIFTRPELIDDAADVIQKLYLISQDLPPKFDVAKRKIERKYSDIEKSLIEEFVLAMDNENLNRMKEIATVLSQFKGYSQCVDAYIDHSQMGCLSSKDVFANFLTLCKYNHEIIVKVFNNPEQVMAKFVLNIFQLKLVEYIDQRLNSKLGTYGYLQVLYELYYKTNQLSNDLSIFNMGNDKNFLSKLTTNIFNKYISDYITMELKGLKDRCSANLQKYYESKGHQKKQIQSGGFQDLRRDLQAVIGTRANINIAQIENYGGETFLSEELAITILQDTKHAFQRCQLLSKPTDRASNATQILDRLINSLLVEHVDYAVELGLQAVPVVEGAKTPPALYFFSVVHHSNNIIHLVEKQFMDLLVPLVENTPRHNDCVQKKKFVLEDIERKINTGLDRCLNAISSWVKLYLQTEQKKSDFKPESDDFDTVASNACKNVINYVNSIVKEIKANLDGNNVTAILQELGIRLHRVVYDHMLQFQYNTAGAMVAICDLNDYRHCTKALGPLVIELFDTLHALCNLLLVKPENLQQVCSEDSLVKLDRTILHNFIQLRSDFKVQKQMILKV

SEQ ID NO: 11286 - protein, 270 aa, Diabrotica barberi; identical to SEQ ID NO: 11062

SEQ ID NO: 11287 - protein, 134 aa, Diabrotica barberi; identical to SEQ ID NO: 11063

SEQ ID NO: 11288 - protein, 417 aa, Diabrotica barberi
MLSALRSMASTLTRTPILRAISARSYSQALPVSGNPSADLRTSTLPNKLVVAAVDNDASLTRVSIVFRAGSRNEKADNLGATHIVRTAAGLSTKNASQFAIIRNIQQVGANLTATSDRETISYTLEGTRSAVEKALPYLAEVATHQEFRPWEVSELSNRLILDILTRPLQLRAIDLLHNAAYRSKGLGNSLFIPKSQVGKVSSETLQHYVASNFVAGRAAVVGTGVSESLLNQFAASLGIGNGEGSTNPSPYKGGELRSNKGGPLAFVAVGGEGAPLKNTKEALAFAVLQKAVCAGPQIKYGVLDHGVYSKALGGSSDVSACAVNVSYSDSGLFGILLAAPAGSVGKAVQSAVNVLKSGSVTDADVQRGKNQLKTSILLNAESGADVVRELGTQAVLAGAPQSANALAAAVDSVKWS

SEQ ID NO: 11289 - protein, 110 aa, Diabrotica barberi
MRRAHAGNYYEPLPQASNEIEDENDRMTNDLQEKIGVLKSLTIDIGNEVKYQDRMLRDVDDDLDKTGGFLGTTMSRVLRLSKGSHNYLILYLFVFSVVVFFVLYLVIKFR

SEQ ID NO: 11290 - protein, 429 aa, Diabrotica barberi
MASTLSARQANREHVLAVSRDFISQPRLTYKTVSGVNGPLVILEDVKFPKFNEIVQLRLSDGSLRSGQVLEVSGSKAVVQVFEGTSGIDAKHTVCEFTGDILRTPVSEDMLGRVFNGSGKPIDKGPPILAEDYLDIQGQPINPWSRIYPEEMIQTGITAIDVMNSIARGQKIPIFSAAGLPHNDIAAQICRQAGLVKIPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHSDVSNQLFLERNQPFLLRKPKPHAPPVMQL

SEQ ID NO: 11291 - protein, 112 aa, Diabrotica barberi
MSRGHAGPRIHVPDELREVLLEFTISYLLEQPGDVISYAAEYFTRLRETRVTSRVYDEAAASQEELVSPDESVMSKDEEPSIRFAGRRKSVFAETYDPEEDDDDDDGAKLVY

SEQ ID NO: 11292 - protein, 806 aa, Diabrotica barberi; identical to SEQ ID NO: 11068

SEQ ID NO: 11293 - protein, 272 aa, Diabrotica barberi
MARNAEKAMTTLARWRAAQLGEIDKHKKRRPYLASECKNLHACEKWRMQIIREIAKKVAQIQNAGLGEFRIRDLNDEINKLLREKRHWEDQIKELGGPDYQRVGPRMLDHEGKEVPGNRGYKYFGAAKELPGVRELFEQEPPPPPRKSRAELMKDIDADYYGYMDDDDGILIPLEVKAEKTAVQNAVAEWVSKKEQNLENAENQTEEESIYAVQESDDEESKETVQQLVDGSQQRFVAHVPVPSQQDIEQALLRRRKLELMEKYGVEEEPKS

SEQ ID NO: 11294 - protein, 215 aa, Diabrotica barberi; identical to SEQ ID NO: 11070

SEQ ID NO: 11295 - protein, 835 aa, Diabrotica barberi
MPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEEGEDAVDDPRKLKPGEIDPNPETKPARPDPKDMDEDELEMLSEARARLANTQGKKAKRKAREKQLEEARRLAALQKRRELRAAGIEVTSRRKKKRGVDYNAEIPFEKRPAIGFYDTSNEVLDPMAPDFSKMRQQHLDGELRSEQEERERKKDKQKLKQRKENDIPQAMLQNQEPAKKRSKLVLPEPQISDQEMHQVVKLGKASEAAREIVTESGVETTDTLLNDYTFNPQAAATPRTPAPQTDRILQEAQNMMALTHVDTPLKGGINTPLHNSDFSGVLPQAQTVSTPNTVLATPFRSSRSDGAGTPGSSVGFMTPRSGALVPVGKTPVGMTPSVRDKLSINPEEAMDVGSTPAEHRMYQMSMKDQLKMGLSSLPQPKNDYEIVVPENEDQEEPEQAQSQMIEDQADVDARKQEELKAKAARELALRSQVIQRDLPRPQEVNMTVLRPSHESYSLSDLQRAEELIKREMVTMLHFDNLKNPVPTQSKRSNMSQAHQLAFLEQHPYESFRKEDLEAAKGILKREMEVVRNGMNHGELPIEVYTQVWEECLSQVLFLPNQTRYTRANLASKKDRLESAEKRLEQNRSHMAKEAKRAAKMEKKLKILTGGYQSRAQVLIKQLQDCYENLDSTNLELNTFKFLQEQEKSALPRRIQSLTEDVSRQTERERGLQKKYGDLQAEIKYLQESYLSQLQKEQRKEADNTANEVSSTTNGELNAEAADDDEDM

SEQ ID NO: 11296 - protein, 157 aa, Diabrotica barberi; identical to SEQ ID NO: 11072

SEQ ID NO: 11297 - protein, 416 aa, Diabrotica barberi
MYGLQRISYRIYIRNGFRHYSQQPAKRNSFIGRLFENFKDEMAKNKEMKESLKKFREEAQKLEQSDALKAARQKFESVEKEASKGSEVFKESLGSVKERLKGVIDEASKSDLAKKAGKFTEEVGKTTHKISETAQEISKTGAFQSISQATKAVKQEIDNTSIEGRVYVSPKILRKRTETSAVVHQKYYEPNTDATGVELHKDSKFYESWQNFKDNNPYVHKVMDWKLKYDESENPVIRASRALTEKVGDIMGGLFQKTELSETLTEICKIDPAFDTKRFLKQCETDIIPNILEAMTRGELEVLKDWCHEGPFNLFAVPIKEAYKKGYKIESKILDIDHVDLVLGKVMDQGPVLIISFTSQQVMAVRDAAGGVVEGDPDKVMRVNYVWVLCRDVTEPDPRAAWRLLDLSASSNEQLV

SEQ ID NO: 11298 - protein, 309 aa, Diabrotica barberi
MSSDSELSDSDIELQQAFADGKLQPGLNTVEEGPKQFTNNVSGLKQKLEEIKLKLPWIERLDCVNAQAPLAPELAAQMLTHEEKRSNELKNNKKLTQFTPSEDPVLNDFKREMMFHRQAQAAILDSIPKLKDMGILTKRPDDYFAEMAKTDAHMQKIREHLMTKQEQQKRSERVKQLRQQRKEGKMLQVQTKLQRQQEKKDMLAQVKKVRKGMSKDLDFLDGKNKSAAKKMAEKRKMKDKKFGFGGKKKGMKRNTRDSAADISEFKNPGKPGKKFNNSGKGVKGGKMGQGAKQRMGKSKRIKMRSKGRK

SEQ ID NO: 11299 - protein, 683 aa, Diabrotica barberi
MNPGAPNYPMASLYVGDLHSDITEAMLFEKFSTAGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDENGSSKGYGFVHFETEEAANKSIEKVNGMLLNGKKVYVGRFIPRKEREKELGEKAKLFTNVYVKNFGEDLSEEELRNMFEKYGKITSYKIMSKDDGKSKGFGFVAFENPEAAETAVEALNGKELMEGKPLYVGRAQKKAERQQELKRRFEALKMERLNRYQGVNLYVKNLDDTIDDERLRKEFSPFGTITSAKVMMEEGRSKGFGFVCFSSPEEATKAVTEMNGRIVGTKPLYVALAQRKEDRKAHLTSQYMQRMANMRMHQMGQFIQPGASSGYFVPTIPTAQRFYGPAQMAQIRTSPRWPAQTPVRPGAQGGATAYTGMPNTYRAATRPPNQSTTMRSNISVPRPITGQQPQSGVVPSTGRTANFKYTSNMRNPPRATAYTGMPNTYRAATRPPNQSTTMRSNISVPRPITGQQPQSGVVPSAGRTANFKYTSNMRNPPQSMGGIPGTAAPVQQAVHIQGQEPLTATMLAAAPPQEQKQMLGERLFPLIQRMYADMAGKITGMLLEIDNTELLHMLEHQESLKNKVEEAVAVLQAHQAKQAATQIKKD

SEQ ID NO: 11300 - protein, 852 aa, Diabrotica barberi
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSGLVEDQGFLEQLKELLSDSNPMVVANAVAALSEINESSPTGQPLVELSTNTINKLLTALNECTEWGQVFILDSLSNYTPRDEREAQSICERITPRLAHANAAVVLSAVKVLIKMMEILAGDTDFCNTLSKKLAPPLVTLLSSEPEVQYVALRNINLIVQKKPDILKHEMKVFFVKYNDPIYVKLEKLDIMIRLASQVNIAQVLSELKEYATEVDVDFVRKAVRAIGRCAIKVEPSAERCVATLLDLIQTKVNYVVQEAIVVIKDIFRKYPNKYESIISTLCENLDTLDEPEARASMVWIIGEYAERIDNADELLDSFLEGFGDENAQVQLQLLTAVVKLFLKRPQHTQGLVQHVLSLATQDSDNPDLRDRGFIYWRLLSTDPAAAKEVVLADKPLISEETDLLEPTLLDELICHISSLASVYHKPPTAFVEGRSAGIRKSLPARQGSAEDTSSAPEPTVIPNQESLIGDLLSMDLNAPAPAAAQAAVPASNVDLLGGGLDSLLDIGTTPAPPTSTGLLGDIFGIPTAPTMYTPPKTIWLPAEKGKGLEIHGAFSRRAGQMSMDLTFTNKAMQAMSAFAIQFNKNSFGIVPGSPLTVPALQPGQSLEYNLALATTGPVQRMDPLTTLQVAIKNNVDIFYYACQIPIQILFTEDGTLDKRVFLTTWRDIPAANEVQYTVNDVKGNTDGVSSKMTLNNIFTI

SEQ ID NO: 11301 - protein, 165 aa, Diabrotica barberi; identical to SEQ ID NO: 11078

SEQ ID NO: 11302 - protein, 364 aa, Diabrotica barberi; identical to SEQ ID NO: 11079

SEQ ID NO: 11303 - protein, 304 aa, Diabrotica barberi
LNMASDGDDVISDQEKVKIVSDFILHSPPGEFNEVFNDVRKLLNDDDLLKEGASGAFAQYNKDQLTPVKIENADHLVLITEYNDLGNNRFFDPRSKQSFTYDHLRKEALDYQVYTPDSASEPWRAALDSEFIQYTRNHYKDGVCSVVGRNQSGVVNLTACIEDHQFSPKNYWNGREDHQFSPKNYWNGRWRSQWSISLTDDSTAEVRGVLKVQVHYYEEGNVQLVSTKEIKETVPVSSEAQTAKEIIQVIEAAEDLYQTAISENYQNMSDTTFKALRRLLPVTRTKMDWNKIVSYSIGKELKTQ

SEQ ID NO: 11304 - protein, 1355 aa, Diabrotica barberi
MWLKYFVIFVLFSVSVKGLDGDLPPDVETIDVEPTNVSNADPDAGKPIPVEDTPNGAAPVNPNYEVDKSLVNVTNSLVNVTKNPRRTYQTVNKLGKYSTFYAADYDPMTSDTAPPDTDQRGGGTPYTITETRLAEIRKHFMYPFFDKGGSDNNLGDFQKDIQSSIPQVHKNLNFQLPFFGFRYNYTRVSVNGYLEFSDPPPNYDYPLVFPIKEWPKKNDPAFIGIFFSRCRIGNLRDGDIDQRTPGVYFRMERDLRTRQDRMGVEIRERLKWDIRTGVIGSETFDPKHAVIVTWKNVSFTGGFANAKYKTNTFQMVLATDEVFTYAMFNYLNLDWTSHTEAGGDSQNGEGGVSAYVGFNAGNGTRSYEYNPYSQASVIRDLTAVGFGNGFKGRHIFRIDEDILLGSCNKDIDGANLPLKFAPESGNMLGGTVVNITGPCFNLNDRIRCKFDVSNEVFGYVVDKNRAICVQPQLYAEGWVNLQIAVNSEAFKWKGKYYVESPASATQKIFFKDMKLHEKSPSELKITWEKQNLTTNDNANIRISLWGYRETTMKPVFVYITDIADNVQNIGEYTIVPSQFRTKVNQYLTDIKFGFLQINLTESIKVNTYTTSQSSIELTPVVWSRPIPLGWYFQFQWENQYGKNWPKYLCDDWLRTDRYLKNFAHELAQCPCTVEQALADKGRFMPDFDCDKDSNPICYYNNQALHCVKTGSPTLEGSEQQCCYDKNGFLMLSYDQQWGSSPRRCHNLGKMPYNEATKVPTLSQWFNDMVPKYLCCLWQDEQAVGCETLRFERRPTQDCVAYQAPGVAGVYGDPHFVTFDDVEYTFNGKGEFALVKSVTQTDNLEIQGRFEQMDPNTYGEVRATQLTSVVAKGNNTIAIEVRRRPLDSRWRYRLDVIADNRRLYFDRPSLKFQHFQGVTIYTPTYILNQSEVIIMFDNGAGMEVVDNQGFMSARVFLPWSFINKTIGLFGNWSFNKEDDFTLPDGSRAAIVNNINDMERVYNDFGSKWMLEDVLDPQKGRALFHREFGRTSATYNNKTFKPQFLMNPEDFLPTNRSTDLKRISEICPLKLYECYYDYAMTVDRDLAHYTKNYKATIYQYKETTRRKVVSCGVLETPRFGRKSTFLFVPGTKVTYECIQEFVLVGDQRRECQADGTWNIPEYGYTYCLRQEEYSSRQAAITSGIILAIIIPLVLLIGYGGYKVYQRLTSNNQNYDYDTVQKTQNLQQFSRTLSPYREEDEDEKYPQSDTDSLSKKRRSYDKSYRTHEPLPNRPNSEFEEKPLDPYDQTFEDDRVSRTPTGSPTSPTSSIQYTTPYSRPDIIRGNSSKNLNYNDMYAEPIKKPKERISASQSSIVTDV

SEQ ID NO: 11305 - protein, 153 aa, Diabrotica barberi
RFFQDLQHWERLCRPKRPISKQPRNAFLSRYTRFVSQDLKMRYVAAYLLAVLGGKASPNAADLEKILGSVGVEAEGERVKKVISELSGKSVEELIAQGREKLSSMPVGGGAPAAAGGAAAAAPAAEEKKEAKKEEKKVESESEDDDMGFALFD

SEQ ID NO: 11306 - protein, 907 aa, Diabrotica barberi; identical to SEQ ID NO: 11195

SEQ ID NO: 11307 - protein, 411 aa, Diabrotica barberi
MSFSFGATPTPPQKTVASGFTLPSNPIVTSTTGFQSSFGSGDNKDQSKPSLFATPSSQPVSFGLTTKATTAPTTLSFGFATPTTVPFGSSTTITPATTPQFGLSLPKASAPATTTFSLLGSAPATTAAAPTGISFGTATTTATTSATGLSFGTPIGTATTTATTSASGLSFGLTTASSTSSAAPTLLSSTTTSTTSSVSASGALSSTTSAPTFATSSLSSTGALTFSQLEDSINKWTMDLEEQGKFFINQAKQLNAWDTLLISNGEKILTLNSSIEKVKQQQQQLDQELDFVLAQQKELEELIVPIEKELLGIPVTDIDRNQMYQFSEIVDSQLKQMSDDLKEVIEHINEANKEEEASNPLSQISRILNAHMNSLQWIDRSTAQISSHLEQIGKMQDSNRRNHSFNNSMNF

SEQ ID NO: 11308 - protein, 193 aa, Diabrotica barberi; identical to SEQ ID NO: 11085

SEQ ID NO: 11309 - protein, 190 aa, Diabrotica barberi; identical to SEQ ID NO: 11086

SEQ ID NO: 11310 - protein, 582 aa, Diabrotica barberi
MNNTKTQEVYSDLTLFTTPDKFFLEPKNGEELLVIERVTEEISVYKNHRHIIPAASSRKDFCGLLGIINLLSGPYLVIATQRDIVGYISGCAVWRLVKAELIPFRSSLNLSPEKQADNEVYLSMIEQVLTTPFQYFCYDYDLTHSLQRLRDISPDFWKQSLWERADQRFVWNGFLLSPFRNVISKKFCLPLILGFVSINFCVINGHSLNWIIVTRRSVFRAGTRLFRRGIDKDGNVANFVETEQIVEYQGDHASFVQIRGSIPLFWQQNPDLRLKPPPTMIDMDPQEQHSTCLKHLEEVATLYGKVVLVNLIDQKGAEGNMEKSFKNAMNSLSYPSARYEPFDFHSECSKMRWDRLKILIDRLALDQDEMGFFLLLRDGSLSSLQDGVFRTNCIDCLDRTNVVQSMLAHRNLEIVLRKLNILHQNQNLEFQYSFEVLFKNVWADNADIISTQYSGTGALKTDFTRTGKRTKAGVFRDGVNSLTRYYKNNLTDGYRQDAIDLFLGYGKPISPLRVDKSWRYITYPSVLLVAVSMFVASAVFPSEYSTESLLFLLFWGSMVYATLHTIFRYGVEFVDRPRLTQS

SEQ ID NO: 11311 - protein, 590 aa, Diabrotica barberi
MAPTIQQNNQNGTANGVEKRPVKTVEKRSDLICKVKYCNTLPDIPFDLKFIAYPFEPIRFIQYNPTSLERNYKYEVLTEHDLGVSIDLINKDIYAIEPGATLDPADEKLLEEDILTPQDSKRSRHHAKSVSWLRRTEYISTEQTRFQPQTMDKVEAKVGYSIKKSLNNETLYMDRDSQIKAIEKTFEDSKNVIEKHYSKPNVVAVDILPVYPDFSLWKYPCAQVIFDSDPAPVGKQVPAQIEEMSQAMIRGVMDESGEQFVAYFLPTEDTLQKRRDDFVNQIPYQDDEEYEYKMAREYNWNVKSKASKGYEENYFFVARPDGIYYNELETRVRLSKRRVKAGAPPSNTRLIVKHRPMDANEFRMQRYREKQLEPPGEDDEEMEVDEPQEEEATQEEQEQEKGEKSPSRSRSRSNSSNRSRSRSKSRSKSRSKSRSKSRSKSRSKSKSQSRSRSRSKSRSRSRSKSRSRSPSRSRSRSKSRSKSRSRSKSKSKSRSRSKSQSKSPSRSRSRSRSKSKSRSRSASGSRSPSGSRSRSPSKSKSRSRSRSRSGSKSASRSRSSSKASSKSGSRSRSGSRSGSGSGSGSGSESD

SEQ ID NO: 11312 - protein, 389 aa, Diabrotica barberi
MPIENLEDQGLEKNPDLELAHCKFLLTLPEYRSDKNVHSKITEAIKKDDMAPWYELICKDAGWKLDANLLSALKAKNAEKIKLLDEAIEDAEKNLGEMEVREAYLRKAEYYSRIGDKDNAVSTFRQTYDKTVSLGHRLDIIFHLIRIGLFFMDHDLITRNIEKAKTLIEEGGDWDRRNRLKVYQGAYCMSVRDFKSAANLFLDTVSTFTSYELMDYKAFVRYTVYTSIISLPRNQLRDKVVKGSEILEVLHSEPFVKDYLFSLYNCQYAEFFTNLAEVETVLRKDYFLNPHYRFYVREMKILAYTQLLESYRSLTLQYMAEAFGVTVEYIDKELSTFIAAGRLHCKIDRVGGIVETNRPDLKNAQFNSVVKQGDLLLNRVQKLSRVINI

SEQ ID NO: 11313 - protein, 786 aa, Diabrotica barberi
MMTSAVRPKTLPNVSQVNLNSPVGFPPPSPYHSEYSNSPQFSPAFTESPNAWVGVPETPEIDSTNVGVPSTYNQRSSEKMKADESLGNGATISAVLYANMNHPEWKKDFPVWSDRYKQIIKKWRTLSQEQKAPYLQHARDNRSQLRMKKAQQDQEKMALQQKSAREAEQERQWKQLQAMRQHQTQQQQNIIHEQRVQAIARVQRSISVDPAQQFLSDQQSPLQPSTPQELSPSATPTPSPRQFIGMKSPTFPLPSPVPQTAIRPPTPSHSPHDVSQASTSDGNDHFIQSPSTPKPSFPNRLPTDQFIHQPATPRPQFGIQRPTLQNFGNTMRTDQQDININRQLRDLLQRQQVKKLDEMLPGKVQQQRVWPPIEQQENEASATTGTSAVVATTADTTFRQPLPPSIVRPRVALSLAGRAGPGTIRVGQLDARMQGLDPRMRLILQQQVGQQRLSAGIQHQFVRFTSTPARPTTLDQYEQLLHRPTPTQIRAPDQQNAPRMTLNQASVIQRPQLVQPTPTTPTTSAADSNPSEEGIPDNVTAELEKLEQETGTMVELQGVSEILGGLGDDDDELLAEMGADFNILEYADPELEALTGGKTNILDLELEEEPVKKEKIVSSAENQPTNQSVNTMSSPVKPKQEPVETPAPKPEPASLPPPPPPLALPQQQQPAPVQQHTPPAAIQQPTQHPPQVQPTMHLTPQQIHQQMVHQVQQAAAQGRPMPPGSKMQTPDGFIGIVMPNNSVQLQIPQNYQQRLLLLQQLQNQKLQMRVGTTTPRVAVVAQSQLP

SEQ ID NO: 11314 - protein, 120 aa, Diabrotica barberi
VDLKVTVTEKPLPPPPLVVTAINIRTCINRKTCGHEIVMASCLTHKKYAVDMQPPDPPFQQHFCVIASPGDQTLPFDIHDALSKYKATKVQKMDSEKGLLNFFVNQFSSIDPDLIVGHDL

SEQ ID NO: 11315 - protein, 373 aa, Diabrotica barberi; identical to SEQ ID NO: 11092

SEQ ID NO: 11316 - protein, 1338 aa, Diabrotica barberi
MNTTTRVDNTQNPVQKIELTSRSIENALILDNNSPRLLDFMNISSQSGSTASGFADHDYPTISGVSQVINNMTQVKCVNSIPLPTEIVDHFSRVQCHCMMGLFCEINRAWLTVDSDIYVWTYEQNTDLAYFDGISETIVCVGLVKPKMGVFHAFIKYLLILATSVDIVVLGVTFTEKPGDTTEEIQLIPDPVFSLPTDGATVTIISSTNDGRIFYGTKEGKLFEIYYQAESGWFGQRCKKVNLSTSTLSFLVPSFLNAALSEEDGICQISIDESRHILYTLTEKGTIEVCDLGEKGNTFSRITKLGQNTLVNQAMNTVKTLDSQNFRPIVSISAIEATESANLNLVAVSQTGVRFYLTVVSLSNLQPNQRPYTLALAHVRLPPGYSANITVRPRAVHVSHYNDRNLVLISTVNDKDVLWCMSSDMFPFGQTLMEAYSVVNLDGPALAISEVRHPTPLPLPPNQEAPPLVVRQHAEPPKKYVVLTSHSVQIFIKLRPVDILNQILRDSQGLDTEALKTFFTIQKEDQACATCLILASLESDENVEVAEYATRAFFLYGGEPKLVPANIYAGPSVFAPQIISTPAPHNYQSQQYQTAQHFQPNNMSQTLPTVPNTTGYEFTGPFVFSAKHNSLYLYLSRILRPIWNMRTVDKLSVDGKVSTTYSTVSSDDCIFILNNLTALHNFLARNTQLSTMSKNQNQFQNTTLNNTSLNMTRMNHTVQDAQMEEKASLNSFKILVSLCCQILGLWRILCEHQFHSLVASLTENEQQILVNTTFKDLFLYRHDICSSLISALVQTYLGDNASVDSISSKLREVCPQMYKTEDMAYSKAIEILKSARTIQNVGEKEELLNSALQICKSIGPNLNIGDVCKEFCNLKGYKAVTELCCHYASKLDPENIAEIYYNAPDSTGDQEGYNYYQNRMEIYRHLLNMLNSMYQELNVTPVPCLNYDLDFSVTQSILADTPAQSQIGYMMKQVITDILETPDQIMHINLYDWLISKNMTGDLLTINNDSLETYLKRTAAQNPNDTVALDLLWKFYEHRNDHAAAAKILNSLASRTGVNIPLKERLAYLARSIMCMRSDKIGYAPYLGVFLRDLEDKLEVAKVQEQILEAVMNQQNQIENYGDIVTALNSGLFEISQLYENFAEPFKLLECQLAIIDCAGYTDPALIETIWQQILTDELKKTTGTGTDKVCQLLNKVKHLAKYYAKSMNCFPLDYIIYELEIVNAKLRGDRQLVPTALESMNIPFDSLISVYNNLNTISGNDHFWQLEENEFHLSEATATLISCFISNQDSYSSIEKRKYTSLSQDTVVALLSNLYSKPNTEAIVNKLRNIQARLARI

SEQ ID NO: 11317 - protein, 1447 aa, Diabrotica barberi
  misc_feature (12)..(26): Xaa can be any naturally occurring amino acid
MLMTFAICCSKXXXXXXXXXXXXXXXFCLHNRQIYKFFIKNKMTEFTLSYREVIPDQTVFENWKEISLTTGGTQSTLQDIKVAERANGFSYEDSTKHHTRNRFIYWRINYDVLELVEHSLDINLTANRVRYKFTDTPILDGVSIHETYENIIVLVPTVCSIHRLIFPHPDRFHRQDDLLGVHPDLAAPSIFSKASPVDARNPNTFYVFNNPTTATDQLPNLASSYLLPETEEAFFILAYPSTELLLIKQNPDNGQVVCTELKGESLMPRFLSGLAEKFRPRNSDGDTIVSLLFYIVDYETYVLTLTRDAHLKFWSCTKGQCVAVIDVREKTGDGSKDRVQGAILRKAVDGNSTESILAVFLNYSSSGQFHILNPIIKGQEITIDRLVTLYSPENDLIDFALQTNRLWSVWRCEDGDSVVYTATLPVSRCASYKSSSWSPIILETLPDANQSPANDGDSDPRQVYLQHIFHPGRFPLHIISKALSIYKRSTILSDAQISASALKQRICLAVDNEIQNTLNGSNVNDDEYLECADWCWQKFYSCCVQYHIASLKPLGLMLLPSVSGAVFLKKSTFSFLRPLDPLEHMTLCYEDVYRDQFVNFSMLAEDLDTTDDVMNLFKVIVYLEQQMSESFVQAFEKEIFNLHAPDVIMEGLLEKIQSEMDCQFASHVLEMMNDVTDLYKGMHKILELLRYENTLASPDNDINPGAMYHFSSLLGTSVVAESLRQQAQIRFQICRNLLLICNILLNEKTLDWGVLEAIRSVCTPEIVVLTQASYVVLWLCGLTTIVNLPFSARESSINRLAPLKLAPVLNLRPLTTCTSLLELFISSTGGQEARKSFARVNCSDEALAHWHISLLPYLNHVRHIIWPITGGTVLAEWLLSSGQHLWLQQYVRLLSNWCEWNSCTRNFLLASAFLSTGEYNKAEDLFETAAKGVLTDGFLQERCLKGNLPSPTGAYIHYYLKVIQLFDLHKAKDSVISIANTALSIVDPEDPLAATLYSIKFKHHLALKHYELAFDSLNANPDAERKKDNLRDLVKTLLDEKKLDTLLNFTYGSMDEFFTNILLSRARANDAVNNIFYDFLYSYQIKRGPLSHRLAASVMYEQAFRLNHINSVEALEKQVKCYLAAKNVLHLCQPEHAWVVRPADPDEEDDVITIQPLAGSNEEMKVFRLRKQLEVVNIETVEKELIFASAKLKLARFSSSLSPVNITTPVELVTLLNTAGLFKTALDICTTFELSYASIFEVLTKNCVSLTEEENPSAWNWLVENDLQDLPVNRDSAADVVWQFLQDCLEKYEKPCMTTLHYVVCKKIIGMRVYFPHWLVASYKVRNPAEFLRLLHGSGRLEEAIEFTSEYILSAMGYGKEFFGFTQPLAPTSPAFCLPVYAIQRLIDELKIQNSMSLEQPYLKEYENLKTLFTKYLETATRVSNQMCQTKLTSGSLRTNVFSIDAR

SEQ ID NO: 11318 - protein, 468 aa, Diabrotica barberi
MEMSDENIQVLSKYLQETLNPDPNVRRPAEKFLEGVEVNQNYPLLILNLVHKPEVDMTIRIAGAVAFKNYIKRNWFVEEDGVDRIHESDRAAIKNLIVTLMLSSPESIQKQLSDAISIIGKTDFPLKWPELISQMVEKFSTGDFNVINGVLRTGHSLFKKYRYEFKSQELWIEIKYVLEKLAQPLTDLFVATINLAQTHSNDVNALKVIYSSLVLICKVFYSLNFQDLPEFFEDNIQIWMSNFHTLLTADVKCLQNTDSEEAGIMEQLRSQVCDNIALYAQKYDEEFQQFLPQFVTDVWSLLVSTGLEPKYDLLVSNALQFLSSVAERVQYRHLFEDNNVLSSICEKVIIPNMEFRVSDEELFEDNPEEYTRRDIEGSDIDTRRRAACDLVNTLSQNFEQRIIDIFGQYLQVMLGKYVENTKQYWRSKDAALYLVTSLVSRGATQRHGVTQTSQLVDINQFCQQHILS

SEQ ID NO: 11319 - protein, 202 aa, Diabrotica barberi
MAKVQLCNITVMDNPSPFLNPFQFEITFECIEELREDLEWKMIYVGSAESEDYDQTLDSVFVGPIPEGKHMFVFQADPPNVSRIPENDALGVTVVLLTCSYRSQEFIRVGYFINNEYTDPELKENLPSPPQFDKVTRNILASEPRVTRFKINWEETNPTENITNSDQSGASAPTTSEAGPSAPVEVPAFNENSNSWATMECS

SEQ ID NO: 11320 - protein, 316 aa, Diabrotica barberi; identical to SEQ ID NO: 11209

SEQ ID NO: 11321 - protein, 130 aa, Diabrotica barberi
MAAIRSMSRLLINRSLQTTAKRTYADQMNFTFAAGNQVYYTATSVKQVDVPSFSGSFGILPAHVPTLAVLKPGVVTVYEDSGNVKKIFVSSGTVTINDDSSVQILAEEAHPVENIDVNAARDILTKAQSQ

SEQ ID NO: 11322 - protein, 328 aa, Diabrotica barberi
MSGDGSDTEQFDTLFLSVAQYHPQGPTQLLDTFVSFLSRKTDFFIGAKEGEWEKLVMDTFRKYEKSSRAKHEEELKEKREQEARKKAAAAKKAEAETVKPAQITELTDEEAERLQAEINAKKNTSDKAESSSNGSEAATTAKKVGEDEDESEKGKILPNSGNGCDLEKYKWTQTLGDIELKIPLKVNFRVKQKDLVVNMTKKHLTCGIKGQPPIIDDDFPHEIKLEESSWVIEDGKDLLFTFEKINKMNWWSQIVKSDPEISTKKINPEPSKLSDLDGETRGMVEKMMYDQRQKEMGLPTSDEQKKQDVINKFMQQHPEMDFSQCKFN

SEQ ID NO: 11323 - protein, 159 aa, Diabrotica barberi
MQSSSGMIHGYPGGPGLQWSPDKKHSDRERWICIYPAYINNKKTLAQGRKIAKERCVENPTHQEIRDVLVAAGLKVGVENKLYSRERSKEMLYRGRIRIQLKNDDGSLCNDSFPTRDSIMYHLGDMIPKLKSRQNKSSTEAPQQASTGSKGKGKGKGRR

SEQ ID NO: 11324 - protein, 460 aa, Diabrotica barberi
KQFEDNIRKNRTVISNWIKYAQWEESQKEIQRARSIWERALDVDHRNITIWLKYTEMEMRSRQVNHARNLWDRATVRSRQVNHARNLWDRATVLLPRVNQFWYKYTYMEEMLENVPGARAVFERWMDWQPDEQAWQTYINFELRYKEIDRARQIYERFVITHPEVKHWIKYARFEENHGFIHSSRQIYERAVQFYGDDHLDEKSRQIYERAVQFYGDDHLDEKLYIAFAKFEENQKEHDRARVIYKYALDHIPKDETKELYKAYTIHEKKYGDRSGIEEVIMSKRKLQYEQEILQNPTNYDAWFDYLRLVEGEGDLEITRETYERAIANIPPTKNKQFWRRYIYLWINYAIFEELEAKDYERTRQVYKACLEILPHKIFTFSKIWLLFAQFEIRQKNLTTARKILGMSIGMCPRDKLFRGYIDLEIQLREFDRCRKLYEKFLEFGPDNCITWMKFAELET

SEQ ID NO: 11325 - protein, 476 aa, Diabrotica barberi; identical to SEQ ID NO: 11102

SEQ ID NO: 11326 - protein, 160 aa, Diabrotica barberi; identical to SEQ ID NO: 11103

SEQ ID NO: 11327 - protein, 307 aa, Diabrotica barberi; identical to SEQ ID NO: 11104

SEQ ID NO: 11328 - protein, 573 aa, Diabrotica barberi
MLALQQYSGSSDEDDIDKNKSKDTSVDITEIPINSEFSTRNKLAICAAPNVLPTGLDGEKNHIHPDSGELTYNPKYDILFAPVVGPANPFKTQQQSVERNILSGHIETAHVSDFQFENQRRTFTSYGYALDPSISNDGDGHLKVVGSTEEGKDVESVKTVFETSKIRPLDKRKRKRNDNPGDIEGFLGPWGGFVDEQKVSRPTEEEQAELDEITSKKNKKGKPTEDKPIEEKSVLHIKDPVDYQGRSFLHAPQDVGVNLKSDTPPEKCFLPKSHIHTWTGHSKGVAAIRWFPRTAHLFLSASMDCRIKIWEVYNERRCIRTYYGHRQAVRDINFNNSGKLFLSAGYDRYIKLWDTETGQVVSRFTSRKIPYCVKFNPDKNKQHLFVAGTSDKKIICWDTRSGDIVQEYDRHLGAVNSITFVDENRRFVTTSDDKSLRVWEWDIPVDMKYIADPTMHSMPAVTPAPNGKWLACQSMDNKIVIFSAMNRFKINRKKTFTGHMVAGYACSLDYSPDMSYLVSGDADGKVYVWDWKTTKLYKKWKAHDNVCISVLWHPHEASKMISAGWDGVIKFWD

SEQ ID NO: 11329 - protein, 268 aa, Diabrotica barberi
MVQKKPKKKVGKKVAAAPLAVKKVEQKKEVNPLFEKRPRNFGIGQDIQPPRDLSRFVKWPKYIRIQRQKAVLQKRLKVPPPINQFSQTIDKQTATQLFKVLEKYRPETALQKKNRLKAKAEAKVAKKEEAPAKKPNTLKAGTNTVTKLIEQKKAQLVVIAHDVDPIELVLFLPALCRKMGVPYCIVKGKARLGLLVRRKTCSSVALTQVDSGDRSNFNKLLEVIKTNFNDRVDEIRRHWGGGLLGSKSAARIAKLERAKAKELAQKQG

SEQ ID NO: 11330 - protein, 333 aa, Diabrotica barberi
MATLIKDVTLQENIPTHILLDKHIDFIKEYGQKESTYEYGMTDYLRISGMYWGLTALELMNATPAQSIEEITEFIKNCQDPESGGISACLYHDPHILHTLSAVQILCIYNKLEAINVEGVVKYIASLQLPDGSFTGDKWGEVDTRFSFCAVMTLSLLNKMDAIDVNKAVDFVLQCKNFDGGFGSRPLSESHAGLMYCCVGFLSITNRLDAIDRDTLAWWLCERQLPSGGLNGRPEKLPDVCYSWWVLSSLTMLGRLHWIDANALKNFILACQDTETGGFADRPGDIADPFHTIFGLAALSLLGHDSVKKVNPTYCMPQEVIDRLQLKPQRLEQ

SEQ ID NO: 11331 - protein, 948 aa, Diabrotica barberi
MHQEAIQLIQVLEKTVSPDKNELEQASSFLEQAAVTNLLEFIKTLSDILRHGGNSPVARMAAGLQAAVTNLLEFIKTLSDILRHGGNSPVARMAAGLQLKNQLTSKDSNIKTTYQQRWLAFPEDVRGYIKNNVVCALGTETSRPSSAAQCVAYVAVTELPQGQWPDLIATLVNNVCHANSTEMQKEATLEAIGYICQEIDSDVLVSQSNDILTAIVHGMRASEPSNHVRLAATQALLNSLEFTKANFDQPTERNYIMEVVCEATQSPDSQIRVAALQCLVKIMSLYYQHMEPYMAPALFPITLEAMKSENDAVSLQGIEFWSNVSDEEVDLAIEDTEATEAGRPPTRCSRHYAKGALQYIVPILLQKLTKQEELDDEDDWNPCKAAGVCLMLLATCCEDEIVPHVLPFIKENIKSDNWRFRDASLMAFGSILGGLESTTLRPLVEQAMPTLIDLMYDNSVIVRDTAAWNFGRICEIIPEAAINETFLKPLLESLITGLKAEPRVAANVCWAFSGLVEAAYENADVNEETGTPDTYVLSQYFEFIIQRLLETTDRPDGAQHNLRPAAYEALMEMVKNSPKDCYVTVQKTTMVILDRLHQVLQMETHISSHNDRSQFNDLQSLLCATLQSVLRKVTPEDAPRSQFNDLQSLLCATLQSVLRKVTPEDAPHISDAIMTAMLTMFNSNSCKSGGVQEDAIMAVSTLVEVLGENFIKYMDAFKPFLYLGLKNHQEYQVCVTAVGLTGDIFRALKLKALPYCDEIMTLLLENLRDQSVHRSVKPEILGVFGDIGLSIGSEFKKYLEVVLSTLAQASQAQVDRNDFDMIDYLNDLREGVLEAYTGIIQGLKGDGPTPHPDVLILEPHIPFIVQFITVVAQDTEHSDSIIAAAAGIVGDMCNVFGAPMVQFLDLEPINEMLAQGRRSRVNRTKTLANWAVKELKKLKAVNTAAAAS

SEQ ID NO: 11332 - protein, 500 aa, Diabrotica barberi
METILEQQRRYHEEKERLIDAMVKEMLHKKTTFREAINSDHRQKYLLDRYMASTEKLIDLYDDRDGQRKAEVAALTGPNEFQEFYSRLKLIKDFYRRHPNEISVPMSVEFDEFAKARENPNEDMANFVEFTDEEGYGKYLDLHECYEKYINLKGIEKVDYITYLGMFDQLYDIPKERKSGEYKKYLLCLIEYLTWFVQRIKPLKDLDIDLQEQVEQVLINWDNGSVPGWPKETGSALTNVGAHLDLSAFSSWEELASLGLDRLKSALMALGLKCGGTLEERAQRLFSTKGKGSLDPSLMTKNNKGKANKEKELLRQRELATLEAQVYRLAEWVSPQRAATKENVQRKQARTDGERDDSENEESEDDSPDEGDDDVPYNPKNLPLGWDGKPIPYWLYKLHGLNISYNCEICGNYVYKGPKAFQRHFAEWRHAHGMRCLGIPNTAHFANVTQIEDALALWEKLKVQKQSERWQPETEEEYEDSQGNVVNRKTYEDLKRQGLL

SEQ ID NO: 11333 - protein, 212 aa, Diabrotica barberi; identical to SEQ ID NO: 11110

SEQ ID NO: 11334 - protein, 328 aa, Diabrotica barberi
MNFESFDEILDLIKNDITKQQTNFREPIDATERLSVTLRFLASGDSYKTIGNSFRLGFSTVATIVDETSEAIWNRLQPIYMPEPTEEIWEKSILGFKNVWQFPNCLGSIDGKHVTIRCPQKSGSNYFSYLKKFSIVLMAIVDPEYKFICIDVGGYGKNSDGGIFETSAMGRKFANETMNIPPNRPLANENEEIPCVLIGDEAFTLSPYLMRPFPYRQARNDNRKERFNYHLCRARRVVENAFGILAHKWRLFFRPLEVKVQTATKLVKAACVLHNLLRTKNTDEQSLHLQENCNIPLPVVDNLAVDGRRAVNEAFEIREKFVTYFSNL

SEQ ID NO: 11335 - protein, 416 aa, Diabrotica barberi
NPCNPIPLPPEYPRFRYFKLGLRGGTPMWGFGRGAKRIPTPPNAPTKPEEKMANQDSMMLQKMKKEPHLSKVSILKRKVGAGSGKIGSLVSTDYNDMDDSSSTPPITPPLATTSRGGIPKTLPKKILENQSSKDSVIVMHSPEDKQLDMMDFDDDTNTVLSAEVSLSSAAQNDEDMLEMETLSQQDLAEGLSSPLEPDQIADEYLLFPGNMVVDMSAGEHFSEKEEEEETVDEEFNDENMHIMIRSPTTSDYEYIMQSKGKKYNVGVHDENDEMPESPDQEDLAVPSPEVSDLLTNYDENDVLMGDQSNSTPEESISTKEDFEELIDEGSRKNSITKSEVTTKQINEFHKYAGIFNYSKGVVQATQNQTALNKITSVANKKAPAKISLVAGPIVHNLSTGKVNPEKLIITQNPNIL

SEQ ID NO: 11336 - protein, 686 aa, Phyllotreta armoraciae
MPREDSLERHKHKSHKGKKSRSSSRSERSQEKRKHSSSSKKKSSFHEDVDRKKKKKRSKSSSSESESTSSESSGKSVELLKKLEKERLRTAEQKKKEKELLKATETAEEKRLRRLMKKEAKERRRKEKMGWDNEYLHYTNSDNPFGDGNLLTTFVWNKKLSKEGIKDVGHEEIEAINRLKQEENKRELEKVKKRRLERELERQRREEETQMMQRTKEAAQFEEWERQEDKFHLEQARLRSHIRIQDGRAKPIDLLAKYISAEEEVDAVEMHEPYTYLNGLQIKDLEDLVEDIKVYKELERGKNLDYWNDITVIVEDELQKLRKIEKQNDFDFGLNRREGIHQSVATDVTSVFKGKTAAQLAALEKQIGSKISSKADGIDIGYWESLLSQLKAHMARARLRDRHQDSLRRKLQVLKAEQAITGVGQSHSETHSTDNEETTSEPKPGTSQDSLETMAMEESNEKSEDAAHAWLSECFSAYQAGGYSPKFLTPDDTEPGTIVVSEVDDVNRLEFARMQVMGQGSKIENAITKEELLLQKEARKGMDGDEAQFSVEQALDNPVYLWSDKYRPRKPRYFNRVHTGFEWNKYNQTHYDMDNPPPKIVQGYKFNIFYPDLIDKSSTPEYYLTPSPENREFAILRFHAGPPYEDIAFKIVNREWEYSYKRGFRCQFHNNIFQLWFHFKRYRYRR

SEQ ID NO: 11337 - protein, 440 aa, Phyllotreta armoraciae
MDNLEANIMDKSMRSVFVGNIPYEATEEKLKDIFGEVGQVLSFKLVFDRETGKPKGYGFCEYRDQETALSAMRNLNGYEIGGRNLRVDNACTEKSRMEMQNLLNQPPIENPYGEPIQAEKAPEAISKAVASLPPEQMFELMKQMKTTIQNNPTEARQMLLQNPQLAYALLQAQVVMKIIDPHTASTLLHPVNQVPATLLPGDKNVAVQVPISNQYREPPVPVQAPRQEYQPVPAPAVHPNHVQQPVFTGQDVDLRSMGNVTDPRIRPMIVDQDMRQMPNVIQNPLPPTISESLAKAGDSKLDNFSRDPRSVTGGFPSDPRQARMDPRQKNIIPPTSQQVPSSVNPKIMANQAGPAAIRPAQNVTVQAQSAGVVPAASAAAAPANVMSPGIGGAGATDQEKAALIMQVLQLSDEQIAMLPPEQRNSILVLKEQIAKSAHVR

SEQ ID NO: 11338 - protein, 392 aa, Phyllotreta armoraciae
MAHMYAEREKSLLEYRKKWLEHKEVESRLKEMREQLKDLTKQYDKSENDLKALQSMGQIVGEVLKQLTEEKFIVKATNGPRYVVGCRRQLDKAKLKAGTRVALDMTTLTIMRYLPREVDPLVYNMSHEDPGDVTYSAIGGLSEQIRELREVIELPLMNPELFMRVGITPPKGCLLYGPPGTGKTLLARAVASQLDANFLKVVSSAIVDKYIGESARLIREMFNYAKDHQPCIIFMDEIDAIGGRRFSEGTSADREIQRTLMELLNQMDGFDSLGQVKMIMATNRPDTLDPALLRPGRLDRKIEIPLPNEQARLEILKIHALPIAKHGEIDYEAIVKLSDTFNGADLRNVCTEAGLFAIRAEREYVIQEDFMKAVRKVADNKKLESKLDYKPV

SEQ ID NO: 11339 - protein, 259 aa, Phyllotreta armoraciae
MARRYDTRTTIFSPEGRLYQVEYAMEAISHAGTCLGILANDGILLAAERRNTNKLLDEVFISEKIYKLNDDMVCSVAGITSDANVLTNELRLIGQRYLYQYGESIPCEQLVSWLCDVKQAYTQYGGKRPFGVSILYMGWDKHYGYQLYQSDPSGNYSGWKATCIGNNSSAAISSLKQEYKEGNMTLKDAKSLAVKVLAKTLDMAKLTSEKVEMATLTRRNDKTIINILNNKEVEELISEYEKSEAAAEAIKKQEQKSAA

SEQ ID NO: 11340 - protein, 886 aa, Phyllotreta armoraciae
MSESKAEPIKVESKANDDKNKNDLSDEDKQLQEELNLCVEKLQENDSKLYMPALQALGNHIRASTTSMTSVPKPLKFMKPHYDTMKQIFEKITEAPVKSLCADIISVLAMTMGEGRDCLKYRLVSDLDKIGEWGHEYVRHLAGEIAGEWAETDFLVNTEIRDKLILLTKQIVPYNMAHNAEAEACDLLMEIERLDLLEQYVDDNIYQRVCLYLTSCVPYVADPENTTLLQTALMLFRKFKQYPQALRLAMQLNDHSLIEEIFLNCPDTDVQKQLAFMLGRQQIYIEVPDSTPEYEDLIEIMANCHLNNHFLNLARELDIMDPKTPEDVYKSHLENSRPPFGGSQVDSARQNLAASFVNGFVNAAFGQDKLLMEDGNKWLYKNKEHGMLSATASLGLVLLWDVDGGLTPIDKYLYSSEDHIKSGALLACGIVNCGVRNECDPALALLSDYVLHNTNIMRIGAIVGLGLAYVGSNREAVLSLLTPVFSDPKSNMEVIGMCALACGMIAVGSGNLQVTTTIMQTLMEKSETELKDTYARFLPLGLGLCMLGKQEGVDSIIAALEVIPEPFKSMATTMVDICAYAGTGNVLKVQHLLHICSEHYDGDSSDKSSKDKDKKDASEKEKDLSSRQAVAVLGIALISMGEDIGSEMAFRTFGHLLRYCEPVIRRAVPLALGLISVSNPKLSILDTLSKFSHDSDAEVAHNAIFAMGLVGAGTNNARLAAMLRQLAQYHAKDPNNLFMVRIAQGLTHLGKGTLTLSPYHSDRQLMSPVAVAGLMATLVGFLDVKNIILGRSHYLLYTLAAAMQPRMLVTFDEDLNPLPVPVRVGLAVDVVGQAGKPKTITGFQTHTTPVLLAYGERAELATEEYLALTPIMEGFVILRKNPDFNA

SEQ ID NO: 11341 - protein, 451 aa, Phyllotreta armoraciae
MTDSNMDSKEEKQASPENVKLKLEASAPETPPTQTTATGVIRRNFITPAGTIVETNEEQPPEPTIEEVVKTTSSNPSPAEQKTEPAEIVTYAAEVLPQEQREQFADAKSYAVEMPAENFQNQSYTQDISYVNIEGTVVPVTISEIEHPGDYANLQTAQYNNGYTDGTQYLTNHQYQNLYIDRSTVDNSPSATVLYRGDDPNLGASRFQGNYDISSSQSQVNLLPASGEAYYPSTSNWTPTSSGSYQQQYPSGNVLQADSTQAFAGPYINATWSSNSMEDGRQSSQETGNRRNGVTCANCKTNNTTLWRRNNQGEPVCNACGLYFKLHNVNRPISMKKEGIQTRKRRPKNSSVGNPASAAGQVRMGLPSYQYQDIEVQQDQYQLPVNVYSQRPQVSYRHYGTENIGTLNAQPLQPIITHEDEQASVITSTSQQARFRTKVEEDEGSNPSMQS

SEQ ID NO: 11342 - protein, 1608 aa, Phyllotreta armoraciae
MALPGNGIFVVKGEISNLMAAMKRGPKWSSHSYQDDDVDALLRNFQELRDILHNVNDLGYVEPNTFLAPFLNVIRSEETTGPVTSLALSAVNKFLSYGLLDPVQTSIPQTIHTIADAVTHARFVGTDQSSDGVVLMRILQVLRTLTLSPEGSTLTNESLCEIMLSCFRICFETRLSELLRKTAEHYLKDMVQLIFMRLPQFSEDPKLSYVKRLRMQPGDLEQTRTKRKKYLKKENKEVVKVQQQEINVETDIVDMQGAILRNNETTGVSTPSSPNPNDTDVAVDIPVDDSTKNLETSLDDSAEKEVDEPFQDYVNQRGIRFTPQFQQETNLSPYGLACVRELFRFLISLCNPLDKQNTDVMINLGLGLLTVAFEISADNIGKYSTLLALVEDDLCRNLFALMNTDRLTIFAANLQVSFLLFESLRAHLKYQLECYLKKLMEIMRSESNKVSYEHKEIALDNLLQLWRVPGFHAELYVNYDCDMYCANLYEELTELLAERSISTVVGVYHAHLLSLDGLLIIIDGIGKRFDEAKDRSDTDEISSYTGENTRIKGCVKVPDKKVLAAKKAIKKWLPQGTEYFNQKPKKGIQFLQEHGVLKQELDVEEIARFLRENPALNKAMIGEYISNRGNLKILEAFVSTFDFTGIRIDEALRAFLETFRLPGEAPTISLILEHFAEHWHKSNGEPFADVDSAFTLAYAVIMLNVDQHNENAKKQTIPMSPNAFKKNLKGVNGGDDFEEEMLDEIYTSIKSEEIVMPSERTGLVRDNYLWKVLLRKGRSPEGGVYMRDDGGAYDSELFSIAYGPLAAALNSVYERADHEGVQKKVMRGFERCASIASNLNMTSNLDMLLVSLAKFTVFHNHQKQTAVVVQFGSNGKAQLALKTLFMLIHQHGNSTREGWKHLFDLLLALYSNDLLSKGFVEVEDFVEPSGKLCLVYKDAPSAAKQDTGLLSSLYSYMISVENLSKIPSPEEQSLIDKARECIKECNLEQMITDSKFLHQQALFQLVDTLIELSRGPEIQEGSSYDYNENITVFFLELLVKIVIQNRDRVMTIWDRVRDHVYTLVMNSSLMSYQFLLERSVVGLLRIAVRLMRNEEMSHVVLQSLRMLLLLLKGGVLARISRQMAFGLYEMLKTSAQNIHTTADWTVVFALLECVGAGAKPPRPVLTAEETDAKPKPDEETCSKQDEESAEKTNDTTKTASQRPQSPVTSITSPVGTPNTGGWIIVSDEEDLQPHQTRQQTLPIHYHLRLDADLSPHDPLSMLKCCESLAFLVRDVAHITPYNFDVCVRCVRTFVEAALKPPPGNQSNERRSNARKSRKRSPAGSQEEDSSGGDEDEDLPSGYHQVPIQLLDLMHTLHTRTAQIFKWWAEEGGEISGETSLWTQGWCPLLQGIARSCCDVRKTVRTSAIAYLQRALLVHDLQTLTPREWEQCFRRVLFPLMNYLLQSGSPRDAVSTEETRIRAAGVLSKVFLHHLAPLSSLAGFADLWSTVLELMDGYMHADGSELLLEAVPESLKNMLLVMEAAGVFDAPDGKKNVLWTATWERIGKFLPGLKDELFREMGSRKKVVEEREREVNDSDVRKEAECWEKNVGGREQDVDGREKEEVVAC

SEQ ID NO: 11343 - protein, 205 aa, Phyllotreta armoraciae
MSILAYNGGAMVAMKGENCVAIAADRRFGIQAQTVATNFEKVFEMGPHLFVGLPGLATDTQTVMEKLRFRKNLYELKENRRISPKVFAAMISNMLYEKRFGPFFVEPVVAGLAPDTFEPYICNMDLIGCLNEPSDFVVGGTASAQLYGMCESLWEPNLAPDDLFETISQALINAFDRDAISGWGATVYIVEKDKVTIRNLKTRMD

SEQ ID NO: 11344 - protein, 961 aa, Phyllotreta armoraciae
MDGKPDLEVVKSAVSTLYNNPDGGEKERASRWLLELQKSVHAWTVADELLRRCTNADDLQTRYFAAQTMRTKIHQSFHELPREVHESLRDSLLEHMGACAGVDEGAGAAIVTQLSLALADLALLMPDWRTPALDLISRFSAGNNVWPLLEVLTVLPEELESRSVRLGENRRYEVLEDMKFCAPTVNEFLKHCSNLYGRGGSERLAAGHRPIDVKILRCFASWISVGAIGPSQLSEDRVVVDMAFDVLKADEKENITGQLHEAATDCICTLLLRLEDNNNHVALETHLFENIVNLEVAYHASVALEDQAKSTDYCRLFTELAESFLGKIVDDGGGGSGDGGGAKRRTVYAVKCLDLVLMCVGHHDYEVAEITFNLWHMLSEELYQKNNKELTELFKPYVERLITALCRHCQMEPDMEGLLEKGDEFKDFRMKVSDLIKDVVFIVGSSSCFRQMFINLQTSGVTWDASEAALFVMQAVAKNVLPTENEVVPKVVEAILNIPNSAHVAVKYTSVLLLGELAEWIEKHPDALDPVLNFLICCLRSGAEGGGVATAAAAALQNVCTCCGAHMGRHVPILLQLLQQSDSFGIGNTAIIGLLKGVASVVSCGIGSSAETASAVRELCSLQLSPLCSLIENNVRPVKATLTDPVLWLDRLSSVLRYVNVNVVEGEIHPCKPVIMEIWPILSRAFDTYHSDVRIMERCCRSVRFMLRCVARQLQDLLPSLVGQIVHIYRLYGHSCCLYVGSILVDEYAGDATCVQGLLDMLNAFLEPTFRLLQEENGLKNHPDTVDDFFRLCARFVQRAPKAFLSGGAHLAPIMQCSLLAATLDHKEANVSVMKFFYDLINQGLSGRGEPDFDERKALVRSLLNEYGQQLVSNLIHSCVFYLHSYMLSEVGDVFVQLLDFDRQITSEWLANGLELLPKQQNGGIMAAKPKQLNDVHASITRSNSSKSVTHALKDLTRLYR

SEQ ID NO: 11345 - protein, 501 aa, Phyllotreta armoraciae
MAQRFPGPVSNQVPGGPPPPQRYQQQPPNQGMRQYGQQAFPPRPGYNAPPPMQSSGGTMIQRPPGAPYSPMRGGPMPPQPVGKRPSDNRNPLQQKTGDYSHGTSKKKKKLADKILPQKVRDLVPESQAYMDLLAFERKLDSTIMRKRLDIQEALKRPMKQKRKLRIFISNTFYPAKEPQPEGPDGPCQEGTVASWELRVEGRLLEDSKNDPNKVKRKFSSFFKSLVIELDKELYGPDNHLVEWHRTLTTQETDGFQVKRPGDKNVRCTILLLLDYQPLQFKLDPRLARLLGVHTQTRPVIISALWQYIKTHRLQDGHEREYIICDKYLEQIFNCTRMKFAEIPQRLNPLLHPPDPIVINHVISVEGGAESKQTACYDIDVEVDDTLKTQMNNFLLSTASQQEIQGLDAKIHETVDTINQLKTNREFFLSFAKDPQQFIHKWIVSQTRDLKTMTDVVGNPEEERRSDFFYQPWAQEAVCRYFYTKVQQKRAELEQALGIRNN

SEQ ID NO: 11346 - protein, 294 aa, Phyllotreta armoraciae
MPAATLGSIPHPNNEDCGIRDVWAHNLEDEFRTIRQIVQKYQYVAMDTEFPGVVARPIGEFRSSADYQYQMLRCNVDLLRIIQLGLTFLDDNGKTPGGVYTTWQFNFKFNLQEDMYAQDSIDLLQNSGIQFKKHEDEGIEPLEFAELLMSSGIVLMENIKWLSFHSGYDFGYLIKLLTDNNLPQDETEFFDLLKLYFPTIYDVKYLMKSCKNLKGGLQEVAEQLELERIGPQHQAGSDSLLTGMAFFKMKEMFFEDTIDDSKFSGHLYGLGTSFTVNGTTNNYGNDNGDTTNSS

SEQ ID NO: 11347 - protein, 403 aa, Phyllotreta armoraciae
MAEAQKRGASVFEDLSNVEFETSENLDVIEKFKDMKLKEELLRGIFAYGFEKPSAIQQRAIIPVMKGRDVIAQAQSGTGKTATFSIAILQALDLTMRETQVLCLSPTRELAVQIQKVILALGDFMNVQCHACIGGTNLGEDIRKLDYGQHVVSGTPGRVYDMIRRRALRTRSVKMLVLDEADEMLNKGFKEQIYDVYRFLPPSTQVVLISATLPHEILEITSKFMTDPIRILVKRDELTLEGIKQFFVAVEREEWKFDTLCDLYDTLTITQAVIFCNTKRKVDWLTEKMRENNFTVSSMHGDMPQKERDNIMKEFRSGQSRVLITTDVWARGIDVQQVSLVINYDLPNNRELYIHRIGRSGRFGRKGVAINFVKSDDIRILRDIEQYYSTQIDEMPMNVADLI

SEQ ID NO: 11348 - protein, 543 aa, Phyllotreta armoraciae
MTAPAAGGDARGRTLAYKDKSKPADVRTSNINAAKAVCDAIRTSLGPRGMDKMIQAGNGEVTITNDGATILKQINVIHPAAKMLVELSRAQDIEAGDGTTSVVVIAGALLDAAEKLLQKGIHPTAISESFQRAAQLAVEILQGISTPVEITNRELLIKSASTSLNSKVVSQQSSLLGPLAVDAVLKVVEPGHEQACNLIDVKVIKQLGGTVEDTELIEGIVFSQKSANVSGPKKIEKAKIGFIQFCISPPKTDMDHNVIVSDYAAMDRVLKEERAYILNIVKQIKKAGCNVLLVQKSILRDAVSDLALHFLDKIKCMVIKDVEREDVEFVCKSLGCRPIASLDHFTAENLVTADLVEEVGLGGNRMVKITGIQNAGRTVTLLVRGSNKLVLEEAERSLHDALCVIRCLVRKKALIAGGGAPEIEVALKLAAMANKLEGIDAICTRAYATALEIIPFTLAENAGLNPIQTVTELRNRHAKGETSAGINVRKGTITDILEENVVQPLLVSTSALSFATETVRSILKIDDIVSKNFDYFWINGKIS

SEQ ID NO: 11349 - protein, 409 aa, Phyllotreta armoraciae
MEAMDIVIPEKEEGSPSEVKQVLQDLDMEDLYTKYKKLQQTLEFLEVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVQYSDIGGMDMQKQEIREAVELPLTHFELYKQIGIDPPRGVLMYGPPGCGKTMLAKAVAHHTTAAFIRVVGSEFVQKYLGEGPRMVRDVFRLAKENSPAIIFIDEIDAIATKRFDAQTGADREVQRILLELLNQMDGFDQTTNVKVIMATNRADTLDPALLRPGRLDRKIEFPLPDRRQKRLIFSTITSKMNLSEEVDLEDYVARPDRISGADINAICQEAGMHAVRENRYIVLPKDFEKGYKNNIKKDESEHEFYK

SEQ ID NO: 11350 - protein, 162 aa, Phyllotreta armoraciae
MPNIKLQSSDGETFEIDVEIAKCSVTIKTMLEDLGMDEEEEEVVPLPNVNSAILRKVIQWATYHKDDPPPPEDDDNKEKRTDDISSWDADFLKVDQGTLFELILAANYLDIKGLLDVTCKTVANMIKGKAPEEIRKTFNIKNDFTPSEEEQVRKENEWCEEK

SEQ ID NO: 11351 - protein, 345 aa, Phyllotreta armoraciae
MKAANNTKSVKMTSPKLNNVESVDKSEKGKIKNVVIMDDKASCKELDQWIEQLNDCKQLTENQVKTLCDKAKEILSKESNVQEVKCPVTVCGDVHGQFHDLMELFRIGGRSPDTNYLFMGDYVDRGYYSVETVTLLVALKVRYKERITILRGNHESRQITQVYGFYDECLRKYGNANVWKFFTDLFDYLPLTALVDSQIFCLHGGLSPSIDTLDHIRALDRLQEVPHEGPMCDLLWSDPDDRGGWGISPRGAGYTFGQDISETFNHSNGLTLVSRAHQLVMEGYNWCHDRNVVTIFSAPNYCYRCGNQAAIMELDDALKYSFLQFDPAPRRGEPHVTRRTPDYFL

SEQ ID NO: 11352 - protein, 533 aa, Phyllotreta armoraciae
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGQ

SEQ ID NO: 11353 - protein, 540 aa, Phyllotreta armoraciae
MMQPQILLLKEGTDSSQGKPQLISNINACQNIVDAIRTTLGPRGMDKLIVSNRGSATISNDGATILNLLDVVHPAAKTLVDIAKSQDAEVGDGTTSVVLLAGEFLKQLKSYIEEGVHPRIIIKAVRKATQICLEKINSLAVKIDKTNADDYRSLLEKCAATAMSSKLINKQKSFFSKMVVDAVLLLDELLPLNMIGIKKVQGGGLEESMLVAGVAFKKTFSYAGFEMQPKIYKDCKIALLNIELELKAERDNAEIRLSSVKEYQKVVDAEWNILYNKLQKIYESGANVVLSKLPIGDVATQYFADRDMFCAGRVQEEDMKRTLKACGGSVMTTVNDLKDDVLGNCQLFEEKQIGGDRYNFFKGCPNAKTCTIILRGGAEQFLEETERSLHDAIMIVRRTIKNDSVVAGGGAIEMELSKLLRDYSRTIAGKEQLLIGAIAKALEIIPRQLCDNAGFDATNILNKLRQKHAQGNSWYGVDVNMEDIADNYETCVWEPAIIKINALTAAAEATCLILSVDETIKNQKSEAPPQVGGRGMGRPM

SEQ ID NO: 11354 - protein, 4655 aa, Phyllotreta armoraciae
MGDSLEASEAAHETQNVALVDFTAFTNFILKAATVLLPEDDSQAEPANLVAAIDDKTNQECIKKFISDPQIVILYVQRNSSKDDDNVQPPEGEEEKEPVTYYISNEVHYSNSKMSSLVCIKRGPVIEADKSIRAQVRLMNFSEGSPYEILHDYVSRTVAPYFKSYVKESGRADRDGDKMAPAVEKTIAELEMGLLHLQQNIDIPEITLQVHPYVASLIKQCADEGRKPKVADFSDKVDDSNFLNQLQHGVNRWIKEIQKVTKLDRDPSSGTALQEISFWLNLERALHRIQEKRESMEVALTLDILKHGKRFHATVSFDTDTGLKQAIATVNDYNPLMKDFPINDLLAATELERIRAAVQLIFSHLRKVRSTKYPITRCLRLVEAISRDLGMQLLKVLGTRRLMHIPFDEFEKVMTQCFEVFSIWDDEYEKLQGLLRDIMKKKRDEHMKMVWRISPQHKKLQSRMDQMRKFRRQHEQLRTVIVRVLRPSIKESAVPAEGSDIEPPKPTFSLDAADANAIEEVNLAYENVKEVDCLDITKEGQDAWDAAVQRYEERIDRVETRITAHLRDQLGTAKNANEMFRIFSRFNALFVRPHIRGAIREYQTHLIQRVKDDIEALHEKFKVQYPQSNSAKISKVRDLPPVAGSIVWAKQIDHQLTTYLRRVEDVLGKGWENHIEGQKLKADGDSFRLKLNTQEIFDDWARNVQQRNLGVSGRIFTIEAVRSRSGRGNVLKLKVNFLPEIITLAKEVRNLKCLGFRVPLAIVNKAHQANQLYPFAISLIESIRTYEMTLEKIEDKASIIPLVAGMRKEVQLVLAEGIQLVWESYKLDLYVQRLSDLVVGFQERVEELVFVGEQLEVDVRSLETCPYSANTFADILSKIQHAVDDLSLKQYSNLHIWVLRLDEEVEKNLARRLQAGIEAWTETLSGQKKEIDHSMDTDAPAQPTHKPGGDPQIQTMIHEVRITNQTMYLFPSIEEARFLIMQQLFAWQAIVTCQQRLQSSRYQVGVDKPVVETYRNILTRLPAGAQPLINAYSAISSKIKEVQNYVNEWLTYQSLWDLQADNLYGKLGEDISKWMECLNDIKKTRTTFDTSDTRREFGPIVIDFAKVQSKVSLKYDSWHKETLSKFGSLLSNEMTSFHANVSKSRSDLELQSIEAASTSDAVSFITYVQQLKRNMKAWEKQVDIYKEGQRILERQRFQFPTNWLHVENLEGEWGAFNEIIKRKDSSIQTQVASLQQKIVSEDKAVESRTNDFLVDWERSKPVEGHLRPDDALSQLQLFESKFSRLKEERDNVAKAKEALDLQDPGGISTSEDRMQVVYEELQDLRGVWSELSRIWQQIDETREKPWLSIQPRKLRQQLDQLSTQLRELPARLRQYASYEYVKKTLQTYTKVNMLIVELKSDALKERHWKQLMKQLRVNWVLSDLTLGQVWDVNLQKNEAIVKDVILVAQGEMALEEFLKQVRESWQNYELDLINYQNKCKLIRGWDDLFNKVKEHINSVAAMKLSPYYKVFEEEASTWEEKLNRINALFDVWIDVQRRWVYLEGIFSGSADIKTLLPVETSRFQSISSDFLGLMKKVSKSPMVMDIVNILGVQRVLERLADLLGKIQKALGEYLERERTSFPRFYFVGDEDLLEIIGNSKNVARLQKHFKKMFAGVASILLNDNNTVITGIASREGEEVVFKTPVSTVEHPKINEWLTLVEKEMRVTLASNLTQAVQDIKQFKDEIDSKSYMEWVDKYQAQIVVLAAQILWSEDVEAALVKMNSEPQKGVLEKVLQQVENTLNVLADSVLQEQPQLRRKKLEHLINEFVHKRTVTRRLIANGVCSNKAFEWLCEMRFYFDPRQTEVLKQLTIHMANARFYYGFEYLGVQDRLVQTPLTDRCYLTMTQALEARLGGSPFGPAGTGKTESVKALGNQLGRFVLVFNCDETFDFQAMGRIFVGLCQVGAWGCFDEFNRLEERMLSAVSQQIQTIQEALKSQKEAAAEGVAIGSISVELVGKQVKVSPDMAIFITMNPGYAGRSNLPDNLKKLFRSLAMTTPDRQLIAEVMLFSQGFRQAEKLASKIVPFFRLCDEQLSNQSHYDFGLRALKSVLISAGNVKRDRIQRIKEGMTQRGETNIDEANIAENLPEQEILIQSVCETMVPKLVAEDIPLLFSLLNDVFPNVQYTRAEMEGLKDEIRKVCTEEYLVCGEGDERGSAWMEKRDTWLSKVLQLYQISNLNHGLMMVGPSGSGKSSAWRVLLKALERFEGIEGVAHVIDPKAISKETLYGVLDPNTREWTDGLFTHILRKIIDNVRGEINKRQWIIFDGDVDPEWVENLNSVLDDNKLLTLPNGERLSLPPNIRVMFEVQDLKYATLATVSRCGMVWFSEDVLSTEMIFENYILRLKNIPLEESEEGFGKKSDIKDDMLSPTLQLQVDVVNLLQPFLGPDGLVVRCLEYAMEQEHIMDFTRLRALSSLFSMLNQAVRNVLQYNHMHPDFPLSSEALDKYIPKCLIYSILWSFAGDAKLKVRSELGDFIRSVTTVPLPSDRNLPIIDYEVTIEGEWSLWSNKVPQIEVETHKVATPDIVVPTLDTVRHESLLYTWLAEHKPIVLCGPPGSGKTMTLFSALRALPDMEVVGLNFSSATTPELLLKTFDHYCEYRKTPNGVILSPIQLGKWLVLFCDEINLPDMDNYGTQRVIMFLRQIVEQKGFYRASDQTWVTLERIQFVGACNPPTDPGRKPLSHRFLRHVPVVYVDYPGETSLKQIYGTFTRAMLRLAPGLKGYAEPLTNSMVEFYLSSQDRFTQDMQPHYVYSPREMTRWVRGICEAIRPLDNLSVEGLVRLWAHEALRLFQDRLVEDTERRWTNENIDAVALKHFPSANCEKALERPILYSNWLSKDYVPVGREQLREYVKARLKVFYEEELDVPLVLFDEVLDHVLRIDRIFRQPQGHLLLIGVSGAGKTTLSRFVAWMNGLSIFQIKVHNKYTADDFDEDLRSVLRRSGCKHEKIAFILDESNMLDSSFLERMNTLLANGEVPGLFEGDEYTTLMTQCKEGAQREGLMLDSNDELYKWFTQQVMRNLHVVFTMNPSTDGLKDRAATSPALFNRCVLNWFGDWSDGALFQVGKEFTNRLDLDKQSWKCPDFFPASCNHISATPNHREAVINACVYVHQTLHKANGRLVKRGSRTMAITPRHYLDFIHHLVKLYNEKRSDLEEQQLHLNVGLNKIAETVEQVEEMQKSLAVKSQELQAKNDAANAKLRQMVKDQQEAEKKKVQSQEIQQQLAQQTVHIKQKKSEVMADLEQVEPAVIEAQQAVKSIKKQQLVEIRTMANPPALVKLALESICLLLGENASEWKSIRAVIMRDNFINSVVNFNTEDIGDDVREKMKSRYLSNPDYNIDKIYHASNACGPLVKWACAQVEYADMLKKVEPLREELNSLETQAETNQKRGEDVKVLIGQLEQSIASYKEEYAQLIAQAQAIKTDLENVQAKVDRSIALLKSLVIERERWEASSETFRSQMSTIIGDVLLSAAFIAYGGYFDQHYRQNLFSTWSQHLTLANIQYRADIARTEYLSNPDERLRWQANALPSDDLCTENAIMLKRFNRYPLIIDPSGQATEFIMNEFKDKKITKTSFLDDSFRKNLESALRFGNPLLVQDVENYDAILNPVLNRELRRTGGRVLITLGDQDIDLSPSFVIFLSTRDPTVEFPPDICSRVTFVNFTVTRSSLQSQCLNQVLKAERPDIDAKRSDLLKLQGEFHLRLRQLEKSLLQALNDAKGKILDDDSVITTLETLKQEAAEIGQKVEETDKVISEIETVSQQYLPLSQACSNTYFTMDSLNQVHFLYQYSLKMFLDVFATVLHNNVKLDGITDYQSRLNVITSNLFSVVYERVARGMLHNDRMTFAILLCRIHLKGRPTEPNLDQEFNFFLRGKEGVFSNPNSAIVDGLNSDQQEAITRLSTKLPAFKKLPEQIKDMPEFGAWLQQSSPEQAVPQLWIEEKQLSAVGRGMYQMLVIQAFRPDRVIAAAQNFVAAVLGADFMYLAEKEMDFATCVEKEIRSNVPALLCSVPGFDASSRVDDLAAELNKQISSIAIGSAEGFNQADRAINMACKTGRWVMLKNVHLAPQWLVQLEKKLHSLQPHAQFRLFLTMEINPKLPVNLLRAGRIFVFEPPPGIRANLLRTFSTVPASRMMKAPNERARLYFLLAWFHAIVQERLRYCPLGWAKYYEFSESDLRVACDTLDTWIDATAMGRTNLPPEKVPWDALVTLLSQSIYGGKIDNDFDQRLLHSFLNKLFTPKSFDSDFALVANIDNGPGGNRHITMPDGTRRDHFLKWIESLADRQTPAWLGLPNNAEKVLLTTRGTDLIAKLLKMQQLEDDDELAYSLDDSSPSDPAAQIDGRPSWMKTLHNSAATWVNLLPTSLQTLRRTVDNIKDPLYRYFEREVNSASKLLMDVLHDLHDVLLICQGEKKQTNYHRTMLSELVRGIIPKNWHRYTIPKGCTVMQWITDFSQRVKQLQKVSQVVSSAGAKELQSFPVWLGGLLNPEAYITATRQCVAQANSWPLEELHLDVTITDSNDKNSIPHDCFAVVGIKLQGAQCRNNQLLLTSSIMIELPITLFRWVRVTGDEKLKEGKLSLPLYLNSTRTELLYTIELNIAAGQDPHSFYERGVAVLTSTSLN

SEQ ID NO: 11355 - protein, 890 aa, Phyllotreta armoraciae
MSRQGPSKRYESDSDSDSVDSAEEARRRDLQERDEFANRLKKRDEDRTRNVVQNFDKKTYEEAAKRLKLDNAGRDKVISELRKTSRFKYLEKRKDDKLQELEADIVDDEYLFEEEILTEREKKERQHKKELLQLAQEHEKARELERIQRYHMPRDLGKDSTADYIEVDELEKVPQSEQKKWEKDQMASAVFKFGAKDVKKTDDYELLLEDQIDFIQALQMPGSTEKKVSQLSDVQKKKLTIEETKKSLPIYPFKDDLIQAVKEYQVLIIKGETGSGKTTQIPQYLHEAGFTADGKKIGCTQPRRVAAMSVAARVAQEMDVKLGNEVGYAIRFEDCTSERTIIKYMTDGTLHREFLSEPDLQSYSVMIIDEAHERTLHTDILFGLVKDIARFRPDLKLLISSATLDVTKFSEFFDDAPVYQIPGRRFPVDIYYTKAPEADYVDACVVSILQIHVTQPLGDILVFLTGQDEIETCHELLQDRVRRLGSKVKELIILPLYANLPSDLQAKIFEPTPPGARKVILATNIAETSLTIDNIIYVIDPGFAKQNHFNSRTGMESLMVVPISKASANQRAGRAGRVAAGKCFRLYTAWSYKHELEESTVPEIQRINLGNAVLMLKALGINDLVHFDFLDPPPHETLVLALEQLYALGALNHHGELTKLGRRMAELPVDPMMAKMILASEKYKCSEEIVTIGAMLSVNGAIFYRPKDKIIHADTARKNFNHLAGDHLSLLNVYNQWRDSDYSLQWCYENFIQHRSMKRARDVREQLVNLMTRVEIEIVSGIDETDNVRKAITAGYFYHIARFSKGGSYKTVKHNQSVTIHPNSALFETLPRWLLYHELVFTTKEFMRQVIEIESKWLLEVAPHYYKAKELEDSTNKKMPKTIGRSKMTD

SEQ ID NO: 11356 - protein, 456 aa, Phyllotreta armoraciae
MKVEEVKSTVKTQRISAHTHIKGLGLDEAGFAIPSAAGLVGQEQAREAAGVVVDMIRSKKMAGRAVLLAGPPGTGKTAIALAIAQELGNKVPFCPMVGSEVYSSEIKKTEVLMENFRRAIGLRIRETKEVYEGEVSELTPVETENPAGGYGKTVSHVVIGLRTAKGSKQLKLDPSIYEALQKEKVEVGDVIYIEATSGAVKRQGRSDAYATEFDLEAEEYVPLPKGDVHKKKEVVQDVTLHDLDAANAKPQGGQDVLSMMGQLLKPKKTEITDKLRKEINKIVDKYIDQGIAELVPGVLFIDEVHMLDIETFTYLHRALESAIAPIVIFATNRGRCLIRGTDDVFSPHGIPLDLLDRLLIIRKIPYNKSEMEQIIKLRAVTEGLEIEQEAISSLGEVGTKATLRYAVQLLTPSFLTAKINGRGNILKSDVEEIGTLFLDAKSSAKILTEHKDKFMT

SEQ ID NO: 11357 - protein, 751 aa, Phyllotreta armoraciae
MTSIIKVQALSGAKDESPPCYLLQVDDVRILLDCGWDEKFDMEFIKELKRHVHTIDAVLISYPDNYHLGALPYAVGKLGLNCPIYATIPVYKMGQMFMYDLYQSQYNMKEFCIFSLDDVDATFEKVVQLKYNQTVPLKGKGYGITVTPLPAGHMIGGTIWKIMKVGEEDIVYCNDFNHKKERHLNGCELKKLQRPSLLITDAFNATYQQARRRARDEKLMTNILQTLRNHGNVLIAVDTAGRVLELAHMLDQLWRNKESGLLAYSLAFLNNVSYNVVEFAKSQIEWMSDNLMRSFEGARNNPFQFKYLQLCHSLGELSKVPSPKVVLASSPDLESGFSRELFLQWCSNPNNSIILTTRTSPGTLARDLIDNGGGRNIDLIVERRVKLEGQELDDYESRQRSKYDKLEDEEADSDSDSDIEMLVTTKGKHDIVIKQEGKISTGFFKVTKKMYPMYPFKEDKIKSDEYGEIIKAEDYKLAEISAEAEDNKENIVIKKEEEEISKYYSFINDLIVTHESFLAEITEQPTKCIILQRTVQVSCQVQYIDFEGRSDGESLMKILTQLKPRRVIVVHGTEENTSVIEKHCLDNLEARVFTPSRGEIIDATSENHIYQVRLTDALVSQLSFQKAKEAEVAWLGAQIVLRESQADAKRMNLDNEEMEVEEEDTRILTLEPLPEGIPHDPVFINEVKLAEFKQVLGRNNINSEFSGGTLWCSNGSLAVRKVDNGKIMLEGCISEDYYKVKELLYEQYAIL

SEQ ID NO: 11358 - protein, 760 aa, Phyllotreta armoraciae
MPPLEVTANTNNEESAPINPVVGIIYPPPEVRNIVDKTASFVARNGPEFEARIRQNELGNPKFNFLNGGDPYHAYYQHKVKDFREGKGQEPNPGLSQAVAKLSVSASAQQKQQEILKQVEQPFVPKDPPAEFEFIADPPSISALDLDIVKLTAQFVARNGRAFLTQLMNREQRNFQFDFLRPQHSLFQYFTKLLEQYTKVLIPPKSMEQRLRDEAKSAKAVLEQVKYRAEWLRYQEQQKAKEEEILERERVAYAQIDWHDFVVVETVDYQPFEIGNFPPPTTPEEVGARILIQERIEEGEDIEMQLESDEDEDPSNADDGLSSMQDKTKRKGGDDNRLQDMEEDTSDEDNDDETGKTSSSSSLIQPPLPPIPDKVLVKKYDPKQAVKVSRPTVGDDYLVSPITGEKIPASKVQEHMRIGLLDPRWVEQRDKQMSDKMNQDTVYAAGSAIDASLKLLAERRTDIFGVGDEETAIGKKIGEEDVRKDEKVTWDGHTSSVEAATRAARANITLEEQIHQIHKVKGLLPDEEKEKIGPKNIGSKKINIQSVITTKPPNPSSQQPKQQVSMIQTGAQPIMPVPTQPTMLAPQPSIMMMPAPPMPNIRPPPLMMPGGVAMGGYSVGPMPGPPGPGMNMAPMKHPSDGPSEEEPTNKKLRNEDSLVPENVFLSRNPSQVSIKISIPVMPEKSEWRLKGQMVSWTLALTESVSNLKAKIQEETNMPPAKQKLFFDGMFFKDSNTLAYYNVTQGAVIQLQIKERGGRKK

SEQ ID NO: 11359 - protein, 324 aa, Phyllotreta armoraciae
MPSTEVTTTKVIVHPLVLLSVVDHFNRMGKIGNQKRVVGVLLGCWRAKGVLDVSNSFAVPFDEDDKDKSVWFLDHDYLENMYGMFKKVNARERVVGWYHTGPKLHQNDIAINELIRRYCPNSVLVIIDAKPKDLGLPTEAYQAVEEVHDDGSPTSKTFEHVPSEIGAEEAEEVGVEHLLRDIKDTTVGTLSQRITNQLLGLKGLHLQLRDIRDYLMQVCDNKLPINHQIIYQLQDIFNLLPDINQDAFNNSFYVKNNDQMLVVYLAALVRSIVALHNLINNKLTNRDAEEGKKEEKKDKDKENKDKDKEKTDKDKETKKDEKKK

SEQ ID NO: 11360 - protein, 550 aa, Phyllotreta armoraciae
MFGGGRAPILVLSQNTKRESGRKVQLENINAGKQIADVIRTCLGPQAMLKMLMDPMGGIVMTNDGNAILREITVQHPAAKSMIEIARTQDEEVGDGTTSVIVLAGEMLAAAEQFLEQQIHPTIIIRQYRQALEDMVQFLEGPLSVPLDRNDKNAVAEVVKGCIGTKFLSKWSDLAVNIALDAVNTVLLEENGRTEVDIKRYAKVEKIPGGSVEESKILRGVMLNKDVTHPKMKRHIKNPRIILLDCALEYKKGESQTNVEISTETDFTKLLELEEDHVKRQCDEIIALKPDVVFTEKGVSDIAQHFLLKAGITAIRRVRKSDNNRIARACGAVIVNRTEELQESDVGTGAGVFEIKKIGDEYFCFVDECKDPKACTILLRGASKDILNEIERNLQDALQVARNIILSPRLVPGGGAIEMAVAQRLMQKATHGPYRALAHALEIIPRTLAQNCGANTIRTLTALRAKHANHTETDKPCTWGIDGETGELVDMKVKGLWEPLSVKLQTYKTAVETAILLLRIDDIVSGSKKKGDKEVPTPSQMQQQEAKETD

SEQ ID NO: 11361 - protein, 233 aa, Phyllotreta armoraciae
MMQTGIRPYYPDYSTVPVERQINPYADNGGSVVAIAGKDFVVIGADTRLSSGFSIYTRNQNKLFPLSETTVLGCSGCWCDTLTLTRILKSRMQMYHQEHNKNMSTTAAAQMLSTMLYYKRFFPYYISNILVGLDNEGKGCVYSYDPVGHCEKATYRAGGSAGALLQPLLDNQIGQKNLQKPSQEDLTQEKAISTLKDVFISAAERDIYTGDSVLIKIITKDGTKEETFDLRKD

SEQ ID NO: 11362 - protein, 299 aa, Phyllotreta armoraciae
MFQFGFNMFPDIPRPFNMTYKCYSVAMFPGNERQDVERGGKIIMPPSALEQLTRLNINYPMLFKLVNKKTSRTTHCGVLEFVADEGKVYLPLWMMHNLVLSEGDLVQMESVSLPVGTFSKFQPLNPDFLDITNPKAVLENCLRSFACLTTGDVIAVRYNQKAYELCVLETKPGNAISIIECDMNVEFAAPVGYKEPEHAKKEEEMSVDPADLMPEPSGFVAFRGAGNRLDGKKRKDSSSSDAPSSKPAYVRGIPDYDYQIGTLDFIRRTVVKPKEKESSDDADDFKAFSGTGFSLRSRN

SEQ ID NO: 11363 - protein, 540 aa, Phyllotreta armoraciae
MSALPGAIAFDEYGRPFIILRDQDRQKRLTGIDALKSHILAASQIAHTVRTSLGPKGLDKMMVSSDGEVTVTNDGATILKMMDVEHEVAKLLVQLSQSQDDEIGDGTTGVVVLAGALLEQAGALLDRGIHPIRIADGFELACQTAVDHLEKIAELFPVSAENTEPLIKVAMTTLGSKIINKCHRQMAEIAVNGVLAVADLEQKDVNFELIKVEGKVGGKLEDTTLVKGVVIDKTMSHPQMPKELKNVKLAILTCPFEPPKPKTKHKLDVTSVEDYKELRLYEQEKFKEIVGLVKKAGATLAICQWGFDDEANHLLLQQELPAIRWVGGPEIELIAIATGGRIVPRFEELSPEKLGSAGLVREISFGTTKDKMMVIEECSNSRAITILVRGGNQMLIDEAKRSLHDALCVVRSLIQEPRVVYGGGAAEIACSLAVAAQADQLASLEQYAYRAFAEALESIPLALAENSGFSAIHTLGEIKAKQAASGDPALGVDCMNIGNINMREQHVTESLRSKRQQLLLATQLVKMILKIDDVRQPGSG

SEQ ID NO: 11364 - protein, 113 aa, Phyllotreta armoraciae
MATAMDVDSEEIELPTSSSSKGEKKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 11365 - protein, 534 aa, Phyllotreta armoraciae
MVSLNPVRILKQEAEDERGEIARLSSFVGAIAIGDLVRSTLGPKGMDKILVSSGRNTGMVEVTNDGATILKSVGVDNPAAKILVNMSKVQDDEVGDGTTSVTVFASELLKEAERLIEQKIHPQTIIAGWRKSVDIARKALLDASNDNSADLAAFREDLMNIARTTLSSKILSQHKEHFAKLAVDAVLRLKGSGDLQAIQLIKKTGGTLQESFLDEGFLLDKRPGVHQPKRVENAKILIANTPMDTDKIKVFGSHIKVDSMAKIAELESAEKDKMKDKVNKILKHNANVFINRQLIYNYPEQLFADAGVMAIEHADFDGIERLALVTGGEIVSTFDHPELVKLGTCDLIEQVMIGEDTLLRFSGVALGEACTIVIRGATQQIIDEADRSLHDALCVLAATVKESRIVFGGGCSETLMATAVARASVNTAGKEALAMDAFARALLQLPTIIADNAGYDSAQLISELKAAHNSGLNTMGLNMEKGEVGDMRALGITESFVVKRQVLISAGEAAEMILRVDNIIKAAPRKRTEDRGMC

SEQ ID NO: 11366 - protein, 281 aa, Phyllotreta armoraciae
MKMFRNQYDSDVTVWSPQGRLHQVEYAMEAVNLGSATVGLKSNSHAVRIALKRASSELSAYQKKIIQIDDHIGITISGLTADARILSRYMRNECLNYKYSLDAYMPLNRLINILGIKMQHCTQRYDRRPFGVGLLLAGYDDNGAHIYQTCTSANFYNCKAMSIGARSQSARTYLEKKLDELPSSSLEDLIKHGLRALRDTLPPEVDLNTKNVSIGYVGKGITFKILEEEETAPYLALIEGEERRGGGGGGGSSEGQADPLRESGDDGPKDPTPTVATDTTE

SEQ ID NO: 11367 - protein, 850 aa, Phyllotreta armoraciae
MVLKPGSKQEPMEITFNDDDLPYEEEILRNPFSVKHWLRYIDHKKTAPYNEMNIIFERALKELPGSYKLWYNYLRTRRNQIKSKCITDPSFEEVNNAFERSLVFMHKMPRIWMDYCTFLTDQYKITRTRKVFDRALRALPVTQHNRIWPLYLKFVQKHDISETAVRVFRRYMKLCPENAEEYIDYLTKVERLDEAAIITAKIVNDDNFVSQQGKSKHQLWNELCELISKNPEKVRSLNVDAIIRGGLRRYTDQLGHLWNSLANYYVRSGLFERARDIYEEAIQTVTTVRDFTQVFDAYAQFEELSLSKRMEEVAAKQNPSEDDDTELELRLARFEYLMERRLLLLNSVLLRQNPHNVQEWHKRVQLYEGKPHEIINTYTEAVQTVDPKLAVGKLHTLWVEFAKFYESNDQIEEARLIFEKASQVPYVKVDDLATVWCEWTEMEIRNENYDEALKLMQKATVMPSRKVAYHDDTETVQSRLYKSLKVWSMYADLEESFGSFKSCKAIYDRIIELKIATPQIIINYGVFLEENNYFEEAFRAYEKGISLFKWPNVYDIWNTYLTKFLKRYGGSKLERARDLFEQCLDGCPSQFAKHLYLLYAKLEEEHGMARHAMAVYERATKAVPENEMFDIFNIYIKRAAEIYGIPKTRQIYEKAIEVLPEDKTREMCLRFADMETKLGEIDRARAIYAHCSQICDPRVTAEFWQIWKEFEVRHGNEDTMREMLRIKRSVQAVYNTQVNMMSAQMLSSAGSSSGTIADLAPGVKDGMRLLEAKAAEMAGSAAAQKSNIMFVRGETQGDNKDKVVNPDEIDIGSEDDEEEEEEEIPLEKQNVPSEVFGSLKKKGHDEDEDD

SEQ ID NO: 11368 - protein, 369 aa, Phyllotreta armoraciae
MANGPIAERNRDATIYVGGLDDKVSESLLWELFVQAGPLVNVHMPKDRVTMMHQGYGFVEFMGEEDADYAIKIMNMIKLYGKPIRVNKASAHQKNLDVGANIFIGNLDPEVDEKLLYDTFSAFGVILQTPKIMRDPETGNSKGFAFINFASFEASDASIEAMNGQYLCNRPISVSYAFKKDSKGERHGSAAERLLAAQNPLSQADRPHQLFADAPPIGMMPMSMAPPPPPLITGMMPPPPPTPGGMPPPPPPVPPPSSFPAGIPPPPLPPSQPPLPPGAPPTLAPVPGGAARPPPPPPWSGAAANVPMPPGPPGPNANFGGMLPPPPPPGGRPLPPNWRPPPPPPPNFGGARPPFPPRGPPPPPPTFDG

SEQ ID NO: 11369 - protein, 257 aa, Phyllotreta armoraciae
MGRVIRAQRKGAGSVFKSHTKRRKGAPKLRYLDFSERHGYIKGVVKDIIHDPGRGAPLALVHFRDPYKFQTRKEIFIAPEGMYTGQFLYCGKKANLQIGNVLPVGTMPEGTIVCNLEEKTGDRGRLARASGNYATVIAHNHDTKKTRVKLPSGAKKVIPSNNRAMVGIVAGGGRIDKPILKAGRAYHKYKVKRNCWPKVRGVAMNPVEHPHGGGNHQHIGKASTVKRGTSAGRKVGLIAARRTGRIRGGKVETKKDD

SEQ ID NO: 11370 - protein, 136 aa, Phyllotreta armoraciae
MARTKQTARKSTGGKAPRKQLAAKAARKSAPSTGGVKKPHRYRPGTVALREIRRYQKSTELLIRKLPFQRLVREIAQDFKTDLRFQSSAVMALQESAEAYLVGLFEDTNLAAIHAKRVTIQPKDIQLARRLRGERS

SEQ ID NO: 11371 - protein, 530 aa, Phyllotreta armoraciae
MAISLLNPKAEVARAAQALAVNITAAKGISEVMKTNLGPKGTMKMLVSGAGDIKITKDGNVLLHEMQIQHPTASLIARASTAQDDMTGDGTTSTVLVIGELLKQADIYIAEGLHPRTLTEGFDKARAKALEILDKLKIPIEINKESLSDVCRTSLRTKLHQNLADILTDVCVEAILAIKQSDKPVDLHMVELMEMQHKTETDTQLVKGLVLDHGGRHPDMPKSLKNCYILTCNVSMEYEKSEVNSGFFYKTAEEREKLVLAERDFIEQRVKKVVELKKALCKDTNKTFVVINQKGIDPMSLDMLAKEGIIALRRAKRRNMERLALACGGTAVNSFDDLQESHLGYAGHVYEHVLGENKYTFVEECKVPQSVTILMKGPNKHTLLQIKDAVRDGLRAINNAIEDKALIPGGGALEVAVNKELLAYKDEIKGKARLGVAAYAEALLVIPKTLAVNSGFDAQDTIVKLQEEARLSSEPIGLDLTSGEPINPKDAGIYDNYVVKKQIINSCSIIASNLLLVDEIMRAGMSSLKG

SEQ ID NO: 11372 - protein, 1041 aa, Phyllotreta armoraciae
MSSAGIADSPIDPPAKKRKLDSKNCGTDMANNEASGSSNAGEIDEGLYSRQLYVLGHDAMRRMATSDVLVSGLGGLGVEVAKNVILGGVKSVTLHDDALCTVRDLSSQFYLTEADVGKNRAEACCKHLSELNTYVPTKPYTGPLDEKILQKYRVVVLTNSTRAEQLRISEITHNNDIALIIADTKGLFAQVFCDFGKAFSVVDVNGEPPVSTMIADISNDTESVVTCIDDTRHGMEEGDYVTFSEILGMTELNNCKPIKIKVLGPYTFSIGDTTKFSKYVRGGIVTQVKMPKEVHFKPLKESLQNPEFVVTDFGKFDHPIQLHLAFSTLHKFVEKTGRLPKPWNKDDASEFIALAKSLAVNGSTDTEVNTDILNIFSKCCSGDLNPINATIGGIVAQEVMKACSGKFFPIYQWLYFDAIECLPQDKEEITEELAAPVDGRYDGQIAVFGKDFQKRLGELKYFIVGAGAIGCELLKNFAMMGLGTQGGQITVTDMDLIEKSNLNRQFLFRPHNVQQPKSATAAKVIKKMNPDVNIVAHENRVGPETESVYNDEFFEVLDGVANALDNVDARIYMDRRCVYYRKPLLESGTLGTKGNTQVVVPFLSESYSSSQDPPEKSIPICTLKNFPNAIEHTLQWARDNFEGLFRQNAENASQYLRDPEFIERTVKLPGVQPLEVLESVKAALIDERPKDYDDCLAWARLHWEDQYANQIKQLLFNFPPDQLTSTGQLFWSGPKRCPEPLVFDINEDLHVDYVIAAANLKAQVYGIPTNRNRCYAKQVVTSIEVPPFVPKSGVKIAVTDSQMAMNGNNVDLDRINQIKQELPSMEELNGLTLTPLEFEKDDDSNFHMDFIVAASNLRAANYKIPLADRHKSKLIAGKIIPAIATTTSVVAGLVCLELYKLARSIKSLTPFKNGFVNLALPFFGFSEPIAAPKMEYCGNQWTLWDRFEVQGEMTLAEFLEYFKEKHGLEITMLSQGVCMLYSFFMPKAKAQERLGLTMSEVVRRVSKKKIEPHVRALVFELCCNDADGEDVEVPYVKYNLY

SEQ ID NO: 11373 - protein, 428 aa, Phyllotreta armoraciae
MADADAADDLLDYEDEENPEQTANENNATEGQKKGVKGTYVSIHSSGFRDFLLKPEILRAIADCGFEHPSEVQHECIPQAVIGMDILCQAKSGMGKTAVFVLATLQQLEPTENVVYVLVMCHTRELAFQISKEYERFSKYMSNIKVGVFFGGLPIQKDEEVLKNSCPHIVVGTPGRILALVRSKKLNLKHIKHFILDECDKMLELLDMRRDVQEIYRNTPHEKQVMMFSATLSKEIRPVCKKFMQDPMEVYVDDEAKLTLHGLQQHYVKLKENEKNKKLFELLDVLEFNQVVIFVKSVQRCVALAQLLTEQNFPAIGIHRGMEQKERLSRYEQFKDFQKRILVATNLFGRGMDIERVNIVFNYDMPEDSDTYLHRVARAGRFGTKGLAITFVSEEGDAKILNEVQDRFDVNITELPDEIDLSSYIEGR

SEQ ID NO: 11374 - protein, 490 aa, Phyllotreta armoraciae
MGALETDVEMKNADSPTGLEAGDNKRDKDLNSFTEIREQAKQIEKGIINKEGRFILRVLRCLPNTRRKLNGIVLRTLINHIYPAVDRDVLLSFIEESAGELDTTQTKARPATKSPVAEIDTYINLLCLVHLIDTNKLVEAERCSQILMNKITSQNRRTLDLIAAKCYFYYSRVAELTDKLDSIRRFLHSRLRTATLRNDFEGQAVLINCLLRNYLHYSLYDQADKLVNKCVFPETASNNEWARFLYYLGRIKAARLEYSVAHKHLIQAMRKAPQNTAIGFRQTVQKLTVVVELLLGDIPERQIFRQASMRHSLAPYFQLTQAVRMGNLHRFGEVLENFGPQFRQDHTFTLILRLRHNVIKTAIRSIGLSYSRISPQDIAKKLGLDSAEDAEFIVAKAIRDGVIEAILDPQGGYMRSKESTDIYCTKEPQLAFHQRISFCLDLHNQSVKAMRYPPNAYGKELESAEERREREQQDLELAKEMAEDDDDSFP

SEQ ID NO: 11375 - protein, 560 aa, Phyllotreta armoraciae
MASSHQALPVSAILKSKSEVEDEPKKKSREDWRKAKELEEARKAGTAPAAVDEEGKDINPHIPQYISTAPWYYGTTGPTLKHQRPQDEKNKEYSDLNDWYKRGVDTSKIITKYRKGACENCGALTHKKRDCMDRPRKVLAKYSGANIAPDEFIQKNLSLSFDGKRDRWSGYDPSEHKTVIEEFQKVEEAKRQLKSDKLNANEESEDEEKDEDKYVDEVDMPGTKVDSKQRITVRNLRIREDTAKYLRNLDPNSAYYDPKTRSMREDPNPGNDATYHGENFVRFSGDTTNHARAQLFAWEAHGKGVDVHLLAEPTKLELLKKEYEKKKDEVKSNIQGTVLEKYGGEEYLEAPPKSLLLAQTENYVEYSRSGKIIKGAEKEVIKSKYEEDVYINNHTSVWGSYWRGGQWGYRCCHSFIKNSYCLGEAGKSVNAQPTSEIKNNDEPKEEQLQEDEEKEKSEVLDKESEESDSSSSSEDEKSKAKSKKKLKKKLKKQKKKQKKKDKDKEVKASASIKEVDEEVILDDRKRPYNSMFEAKKPTDEQMEEYFKKRRRDEDPMNQFM

SEQ ID NO: 11376 - protein, 208 aa, Phyllotreta armoraciae
MGISRDHWHKRRATGGKRKPLRKKRKFELGRPAANTKLGTRRIHYVRTRGGNLKYRALRLDTGNFSWGSEGTARQTRIIDVVYNASNNELVRTKTLVKNAIVVIDATPFRQWYESHYILPLGRKKGAKMTPEEEEIFNKKRSKKVQKKYETRQKTAKVEPAIEEQFHTGRLLACLASRPGQCGRADGYVLEGKELEFYMRKIKSKKAK

SEQ ID NO: 11377 - protein, 311 aa, Phyllotreta armoraciae; identical to SEQ ID NO: 11043

SEQ ID NO: 11378 - protein, 486 aa, Phyllotreta armoraciae
MRYVKNYFHIHLFRIYTFSHLIVFCYFQNVIKLILFENFGKMGQGSLTKLKRNKRKKSLLASTSKGLEIKPSSELIVNMVTCVERNPKMEVDGPLKGEGFRSYYITKIEELQLIVAEKSQNLRRLQAQRNELNAKVRMLREELMLLQEQGSYVGEVVKPMDKKKVLVKVHPEGKFVVDIDKNIDINDVTPNCRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 11379 - protein, 199 aa, Phyllotreta armoraciae
MVKLYCISILYKDTTYATWLKSAFDLQSFSFFQRGSIQEFMSFFCKTIVERTIPSSRQSVKEGEYMCHVYVRHDNLAGVVISDHEYPSRVSHTLITKILDEFAAKIPAVNWPTLQEKDVTFPLLNTYLAKYQNPKEADAMTKIQEDLDETKIILHNTIQAVLERGEKLDDLVNKSEGLSIQSKAFYKTARKTNSCCNFT

SEQ ID NO: 11380 - protein, 242 aa, Phyllotreta armoraciae
MFLTRSEYDRGVNTFSPEGRLFQVEYAIEAIKLGSTAIGICTSEGVVLAVEKRITSPLMEPTTIEKIVEVDKHIGCAVSGLMADSRTMIDRARVECQNHWFVYNENITIESCAQGVSNLAIQFGDSDDDGAAMSRPFGVAILFAGIDEKGPQLYHMDPSGTFVQFDAKAIGSGSEGAQQSLQEVYHRSMTLEEATTAALTILKQVMEEKLNSSNVEVMTMTPKDMFHMFTKEQVEEVITKLS

SEQ ID NO: 11381 - protein, 385 aa, Phyllotreta armoraciae
MTEYWLISAPGDKTCQQTWDTMNNLTSKQNNLSANYKFQIPDLKVGTLDQLVGLSDDLGKLDGFVEQVTRKVAQYLGEVLEDQRDKLQENLQANNTDLPSYLTRFQWDIAKYPIKQSLRNIADIISKQVGQIDADLKTKSSAYNNLKGSLQNLEKKQTGSLLTRNLADLVKKEHFILDSEYLQTLLVIVPKSQFNEWNATYEKITDMIVPRSSELIIQDHDYGLFTVSLFKKVVEEFKLHAREKKFIVRDFTYNEEELAAGKNEITKLVTDKKKQYGPLVRWLKVNFSECFCAWIHVKALRVFVESVLRYGLPVNFQAILIHPNKKQAKRLRDVLNQLYGHLDSSAALSGPNVDSVDIPGLGFGQSEYYPYVYYKINVDMIESKV

SEQ ID NO: 11382 - protein, 557 aa, Phyllotreta armoraciae
MSILASPLSVAGSRTTGASVRTQNVMAASTIANVVKSSLGPVGLDKMLVDDIGDVTVTNDGATILRLLEVEHPAARVLVELAQLQDEEVGDGTTSVVIIAAELLKNADELVKQKIHPTSIISGYRLACKEACRYIQDHLTIPVEELGKESIVNVAKTSMSSKIIGADADFFSQMVVDAATAVKVTDSKGNSMYPIKAVNVLKAHGKSARESFLVAGYALNCTVASQAMPKKILNAKIACLDFSLQKAKMKMGVQVLITDPNQLEGVRARELDITKERIQKILATGVNVVLLSGGIDDVCLKYFVERGAMAVRRVKKADLKRIAKATGAAFVTSLSNMEGEETFDAAMVGEAAEVVQERISDDELIVIKGPKARTAASIILRGPNDFYCDEMERSVHDALSVVKRVLESKSVVAGGGSVEAALSIYLENFATTLSSREQLAIAEFARSLLVIPKTLAVNAAQDATDLVAKLRAYQNSSQTKKDHAHLKYVGLDLIEGTVRDNRKAGVLEPTMSKVKSLKFATEAAITILRIDDMIKLDAEQKGGKSYHDAMESGELYD

SEQ ID NO: 11383 - protein, 255 aa, Phyllotreta armoraciae
MFNSTYSAPPPFWSNGPAPGAFYNFPGTEWKPITNPITHTQSPVTTSTSIVSITYDKGVLIAGDLLASYGSLARYKNCPRVIEINPNIILGAGGDYADFQYVKSFIEQKIIDEDCLDDGLKMKPKSLYCWLTRIMYQRRSKLDPFWNNLVVGGIQDGVPFLGTVDKLGTAYTDKVICTGYGAHIALPVLRDALDKKPNLNLNEAKQLIKKCMEVLFYRDARSYPKYQLGMIDADEGVKIEGPIAVEENWNIAYMT

SEQ ID NO: 11384 - protein, 700 aa, Phyllotreta armoraciae
MEFSKEPNFELTAKDFSPEKYVKKLSQNYVGGSELQNLRRKIQGLSEETSSNLKKNVYENYIQFIETAKEISHLESEMYQLSHLLSEQKALLNCLSATSILEDVQPVNIDRDNKVNEKDLEEENKQKIAAILEKVEGCQEMLKVPGRIFLYEGDLLEIEPTENTALKIVHVYLFTDSFMITTRNSNSRGLMKYIYESIYDLSSLAVVNVRDLGNVKHAFKLLIFPDTRVFQCSSNSNKKEWLDKFDQAKKTKLAQEQQKRESVSEKSPTRVSFESPSYNPFDDVEEETSALHPEWFVDIPEELDVCVAQRHFEDALSLLQKAKEYLTQASSATGDKRDTVFTDIQRKVEQRQNNLTEVLMKELEVNPDKSLQGGLRAARRAVRLLNQLGRETQSCTLFLKLCSSMLRTQCKRVKREGSTTTYIKHLSSVVFTNMCHMSDEFLRAFPDSPACASAYVVWASNELLQFTTHFIKQVFMPQTSLSTVTECIVLVRQQCERLYVYGLDLCYQLDGALRSSLMKALKDARDKLIDSIKLRVLDDKWIPINLHSKSALSRCVQEYSQMGLTNVGSYVSGDTWLQLTASTLSFTKMFLNLLNDCMKLKTTELMYTIDETLYNVFEAQVRHNENALRSELNQDQRNFLTKNAEFLLVSLMQVVQKKYEENVGYECPTLAKLQKEYVALQKGVTPASRSTKAKYSSEFI

SEQ ID NO: 11385 - protein, 1234 aa, Phyllotreta armoraciae
MNELEKLEYLSLVSKICTELDNHLGMNDKDLAEFIIHLSEKNNTLESFKKVLSENGAEFSDSFVSNLLRIIQHMKPKKSTNKEEADKVEKEGLAFKFPGLAIPNEKQIPLQLEEFDEENKNDEIDVVADMMKQLEADAPSQKQTKEKSRSPSIEKKSRVRSRSRSKERRRSRSRSNNRRRTRSRSRDRRRSRSKDRHSRREKRHRSRSNEDYKRRRRDNSYSRDRRERGRSKESERRDRNRSRDDRKRERSRSRTRRRERSYEKKFKSEKDNPEFEDDPTPGKIYNGKVSNVVPFGCFVQLEGLKRRWEGLVHISQLRAEGRVTNVSDVVSRGSKVKVKVLTITGQKVSLSMKDVCQTTGKDLNPLSHATTEREDKDRNPDRPTNNSTSVLRLPVSIDEGEEDSRKRVTRMSSPERWEIKQMISSGCIDKSELPEFDEDTGLLPKDEDGEADIEIELVEDEPPFLQGHGRAVHDLSPVRIVKNPDGSLAQAAMMQSALAKERREQKMLQREQEVDSQPSGKNKNWIDPLPEEESKSMARGIGLQSQDLPEWKKHVIGGKKSSFGKKTNLTIVEQRQSLPIYKLKEELRKAVTENQILIVIGETGSGKTTQITQYLAEAGFTARGKIGCTQPRRVAAMSVAKRVAEEFGCRLGQEVGYTIRFEDCTSPETMIKYMTDGMLLRECLMDLDLKNYSVIMLDEAHERTIHTDVLFGLLKQAVMKRDELKLIVTSATLDAVKFSQYFFKAPIFTIPGRTFPVEVLYTKEPETDYLDASLITVMQIHLREPPGDILLFLTGQEEIDTACEILYERMKSLGPDVPELIILPVYSALPSEMQTRIFEPAPPGSRKVVIATNIAETSLTIDGIYYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLCKMLIMSVALQCSDEILTIVSMLSVQNVFYRPKDKQALADQKKAKFNQPEGDHLTLLAVYNSWKNNKFSNAWCYENFVQIRTLKRAQDVRKQLLGIMDRHKLDVVSAERNTVRVQKAICSGFFRNAGKKDPQEGYRTLVDSQVVYIHPSSALFNRQPEWVIYHELVQTTKEYMREVTTIDPKWLVEFAPAFFKFSDPTKLSKFKKNQRLEPLYNKYEEPNAWRISRVRRRRN

SEQ ID NO: 11386 - protein, 415 aa, Phyllotreta armoraciae
MATKRKNKKNILAKVNFPLYTVQMLTSRHVIVGGGGGTSKTGVENGFEIYEIFHDGHKFSAKEVTRHETGGNVVMNCCVFSDRKNSFLVAGQENYSQLYKVNTKLIEHEQVETVGDTASVRHRNTKSKEHVDNNKNIKKELVFDLNPLDSIQTDFKGSEPLCRVVRINHSGKILATGGTDGDVRLWKFPMMQPLSILKGHTKEIDDIDFSKFDNLIITLAKDGLAILWDAQTGKLKSKLTWKTPEGSKYLYKRCRFGVIEDQKNKCMLYMIANATNSKQTSFLQQWIPEENTLKKFSEFNETLSALAVRDDGRFVAVGTMFSGSVSIHIAFSLQKILVVVGAHSMFVTGLEFLSHENTNHSISSVAETAVLSISVDNQLCIHSVPYRRSIPLWIGIMVLVLVLFITFMLCAFMGL

SEQ ID NO: 11387 - protein, 413 aa, Phyllotreta armoraciae
MAGAMLFERAQSVPSQHDKLLKLNPTDEDDEENIVNKEQDILNLGEKYKKEGKAKELAELIKATRPFLSLISKAKAAKLVRSLVDYFLDLEAGIGIEVQLCKECIEWAKEERRTFLRQSLEARLIALYFDTGMYTDALQLESTLLKELKKLDDKNLLVEVQLLESKTYHALSNLPKARAALTSARTTANAIYCPPKMQAALDLQSGVLHAADEKDFKTAYSYFYEAFEGFDSVESPKALTALKYMLLSKIMINSPEDVQQIVSGKLAIKYAGKDIDAMKAVAQAAHKRSLADFQLAVKQFKHELEDDVIVRAHLGTLYDNMLEQNLCRIIEPYSRVQVEYIAKTIKLPVLQVEKKLSQMILDAKFHGILDQGDGVLIVFEETPVDKTYEMALETIQSMSKVVDTLYQKAKKLS

SEQ ID NO: 11388 - protein, 578 aa, Phyllotreta armoraciae
MASRSKKSSTPSAQQRPASPLSPTRHSRLQEKAELQGLNDRLAGYIDKVRFLEAENNKLSREIQTTQETVTREVSNIKSMYDHELGDARKLLDDTHREKARLEIDVKRLIEENEELKAELAKKSKDLVVAENHARIYESRCNEYQLKSNQATADAKKAIADAKELEKERDKLKKLLDAARKQLEEESLARVEVENHNQSLREELTFKDQIHQQELTETRTRRQVEISEIDGRLAQKYEAKLQEALQELRDQYESQMANNRGEIELLYEQKIKNLQAAADRHQSTASGALDELRQVRTRIDSFSSKIDDLENQNRGLAARARDLEKLLENERIRHAEDLALVERELHRLREEMAQQLQEYQDLMDIKVSLDLEIAAYRKLLEAEEARLNITPTGMEHEVHHRSSSQRRTPVRMGAKRKRALLEETQESSLSDYSVNSSSKGDIEVATVDPDGQFVRLHNKSNQEVPLSGWQVIRRAGDEETFYKFHRTVKVEGNGTVTIWSSDLNKDHEPPSNLVMKGQKWVTGDNMITIVLNNNGEEVASSERVRRQISTSHLRHRELGDEELYHQQGDLQGEKCGLM

SEQ ID NO: 11389 - protein, 692 aa, Phyllotreta armoraciae
MDELQLFRGDTVLLKGKRRKETVCIVLSDDSCSDEKIRMNRNVRNNLRVRLSDVVSIQPCPDVKYGKRIHVLPIDDTVEGLTGNLFEVYLKPYFLEAYRPIHKDDVFIVRGGMRAVEFKVVETDPAPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSEAALQQIREKMDLIDLEDDQIDAEVLNSLAVTMENFRYAMTKSSPSALRETVVEVPNVTWEDIGGLANVKKELQELVQYPVEHPDKFLKFGMQPSRGVLFYGPPGCGKTLLAKAIANECQANFISVKGPELLTMWFGESEANVRDIFDKARSAAPCVLFFDELDSIAKSRGGNVGDAGGAADRVINQILTEMDGMGAKKNVFIIGATNRPDIIDPAILRPGRLDQLIYIPLPDEKSREAIFKANLRKSPVAKDVDLTYIAKVTHGFSGADLTEICQRACKLAIRQSIETEIRRERERALNPNVAMDVSICLHLLKSCLKKI

SEQ ID NO: 11390 - protein, 274 aa, Phyllotreta armoraciae
MSDQFDCALDLMRRLPPQQIEKNLSDLIDLVPSLCEDLLSSVDQPLKIAKDKDSGKDFLLCDYNRDGDSYRSPWSNTYYPPLEDGSMPSERLRKLELDANLAFDQYREMYFEGGVSSVYFWDLDHGFAGVILIKKTGDGSRKIKGCWDSLHVVEVQEKSSGRNSHYKMTSTAMLWLQTNKQGSGTMNLGGSLTRQIEHDAAVNDINPHIANIGRMVEDMENKIRNTLNEIYFSKTKDIVNSLRSVQPLTESRQQQALKQDLAAALQRRQNKSEN

SEQ ID NO: 11391 - protein, 1270 aa, Phyllotreta armoraciae
MERPPRNEPPVEPVNGVVQPPVHPPPDSPGRVTNQLQFLQKTVLKAVWKDKFAWPFQQPVDAKKLNLPDYHRIIKQPMDLGTIKKRLENNYYWSGKECIQDFNTMFTNCYVYNQPGEDVVVMAQTLEKVFLTKVADMPKQEFVVEIPMKGKKGRVSVGGGSTPSSSGPVPAAVPGGVRGRPPATVSSTSTTPIATTTGSSGLPLGTQAPATLPGSTATTTIAPANNNNSSLTPQQLGTPVSSMHGTPGAPLSNSLDPTGVLPGNVMPPAQPAKVKKGVKRKADTTTPATAYDYPTVLESKSAKISTRRESGRQIKKPARREIDLHVPQPAIHKPNDKLTESLKACNEILMELFSKKHSNYAWPFYQPVDAELLGLHDYHDIIKRPMDFGTVKEKMDNREYRTPQDFAADVRLIFSNCYKYNPSDHDVVAMARKLQDVFEVKFAKIPDEPVNRIGGGVNNLPIKSESSSSGSSSDSSSESEDSEEERRNKQLKVLEKELTALQEKMRKLVEESSRRKKEKKKNKMKKKPSGALPAGALPNSSSGLGLRGNKPAAASNAAPKRVKANNKTGAGRKKNAAQPPPMPFDSEDEDNAKPMSYDEKRQLSLDINKLPGDKLGRVVHIIQSREPSLRDSNPDEIEIDFETLKPSTLRELESYVASCLRKKPHKKVAGKSKDEQMAEKKQELEKRLIDVNDKIGNSKKAPKKDEGNKVDPTGAGGPSGRLSSSSSSSDSDSSSSSLSSSSSDSSDSEAGGTTNRSTKKKVNKKSPNPSVDNTTITKPQQPTTAPPMSQTPANASVNANLNVSVSANSNAPPQSVPATTTATPTVNNNFPQSQQQQPVQQAQQMAPNKQQHNLNVNVSSAQQQLVPPLNIKPTGIDKLSAVNPVTPASVPQAPKSVALPTPSPDKPKPNVIAHMETYTDPIEQSLANLEQDTITVQQLTNPIPSHPHMNLNPNLNHPVLQPGSLNMDLKAPVTMSAAMLHHGVPMSMDVGDIPALMQTQASLMHAQNNGFGIKHEFDLTANNNGITSMGLPMEMSISSMFDQLPQHLHGQLIKPDPGQDRLDGLINDRKPPQGVVIGAGPPAASKPQPQGQSFGYKQEKSEHNVKNASSWSSLAKGKSPQNNTPGGSSKQQVMDSFKAFQNKAKEKADREKQRLENLEMKRQQREQAERERLRAEHERRREKEEEDALEKARKAVAEQQPITNQRVEELRSSPGEGSTSPGSLSSGSERISERERQRLQEQERRRREVMENKIDMNMQSDLMAAFEGSL

SEQ ID NO: 11392 - protein, 407 aa, Phyllotreta armoraciae
MSLSTARPLVSVYNQKSEEVKGSGVALHAVFKAPIRPDVVNFVHQQVSMNHRQPYSVSDKAGHQTSAESWGTGRAVARIPRVRGGGTHRSGQGAFGNMCRGGRMFAPTKPWRRWHRRVNINQRRYALASAVAASGVPALVMSKGHVVDQIPELPLVVSDKVQEMHKTKEAVQFLRRIKAWADIQKVYKSQRLRAGKGKMRNRRRIQRKGPLIVYYKDQGLRQAFRNIPGIDLISVQKLNLLKLAPGGHVGRFVIWTESAFQRLDKLFGTWKNPSTEKKGYNLPQPKMSNTDLSRLLKADEIKAVLRAPQKKVVRRVRRLNPLTNTKAMLKLNPYAAVLKREAILKNQKRQLQRDEALAKKRGITLTPDNAVIRTRKLQERRRAQILKDKKSKPKKAVKAPAKPAGKK

SEQ ID NO: 11393 - protein, 1797 aa, Phyllotreta armoraciae
MADYLNSEAEESSEEEELDHRDRKKAQKAKLVDSSDEEEEEDDEEKIREELKDLIDDNPIEESDAESDTSGREKRKKSDDEDLDDRLEDEDYDLLEENLGHKVERRKFKRLRRFDDEESEGEEEHDPEQDREQIAMDIFSDDEKDDRQKKDEERRSERSQRPVVEQESFGVGEEEEEGDYSDADDFIVDDDGRPLIEKKRKKKPIFTDAALQEAQETFGVDFDYDEFTKYDQDEYEDEEDEEEDEYEEDDNERRKHPKKAARKKLTKKSIFEVYEPSELKRGFFTDLDNEVRNTDIPERMQLRDVPITPVTDDSTELEDEAEWIYRQAFCNKAISNVDAHLSAEAREKMKKGSQTVGKIKKALDFMRNQQLEVPFIAFYRKEYVQPELNINDLWKVYKYDAKWCQLKSRKENLLKLFDKMRYYQLDQLVKNPDAPIPDNVRVMKDSDIERLKNVQTAEELNDVHNHFILYYSGDLPAMHAAWRIKEREQRKYEKRQKRLRQIAEAEEGAEIPDEPEDDDDDEPETETLKYANRSGSYALCSKAGLDPLAKKFGLSPEQFAENLRDNYQRHEVDQEPVEPSDVAREFISPKFSTVDEVLQASKYMVALQIAREPLVRKCVREVYFERARINVYPTKKGQKVIDESHNCYSMKYLKNKPVRDLNGDQFLKLCLAEEENLLTITINDNIEGNTSNSYIEEVKQLYIKDEFSKNVQDWNALRMECVERALTKSVLPDLRTELKRTLLSEAKEFVLKACCRKLYNSIKIAPYSITFPDEDEHEWDTSKGVRVMGLAYVPEYSVSAFACIAAPDGDITDYLRLPHILKRKNSFRTEEKLMKEGDLQALKNFIFLKKPHVIAIGGESREALMIADDLKALINELVESDQFPEIKVEIIDNELAKIYANSNKGQSDFRDYPELLRQAISLARKMQDPLIEYSQLCNGDEEILSLRFHPLQEQIAKEELIEALCLEFVNRTNEVGVDINLAVQQAHKSSLVQFVCGLGPRKGQALLKVLKQTNQRLENRTQLVTACHMGPKVFINCSGFIKIDTNSLGDSTEAYVEILDGSRVHPETYEWARKMAVDALEYDDDESANPAGALEEILETPERLKDLDLDAFAEELERQGFGNKSITLYDIRAELNCRYKDLRQPFHSANPEELFDMLTKETPETFYIGKLVTASVIGIARKKPKPDQLDQANPVRNDETGLWQCPFCLKNDFPELSDVWNHFDAGACPGQATGVKLRLDNGIMGYIYIKNISDKPVSNPEERVGVGQLISCRIIKIDVERFSVDCTSKSSDLLDKNHEWRPPRDPHYDTEREEKDNRTEAEKKKEKQRLTYIKRVIVHPAFHNISYAEAEKCMVNMDQGEVIIRPSSKGADHLTITWKVADNIYQHIDIREEGKTNAFSLGKSLLIGNEEFEDLDEIIARHVTPMAAHARDLLYFRYYKDFEGGHKDKAEEYLKDEKKKNASKIHYVVSAAKHIPGKFLLSYLPRNKVRHEYVTVTPEGFRFRQQMFDSITSLFKWFKEHFREPPPGGMTPGTPRMSTGRTPYDMSTEAIQRVAQNLPSDMVQALSAATNQTPHYPHTPGGYGGNYINTPYTPSGQTPYMTPFQTPHAQQTPRYGQQTPSQPSLSNPFLHPGAVTPSQRTPSYRNLSTQSPMIPQSPVPSPGSQSSYSSHMSHHTRASYGDSMRFQPPESPRGYPSSRGSYPDGRYGGSESMDWQKAAEAWASRSKSTPRSEGRGTPRSSGHRTPRNYDNLSESDRSRMKHMSSKSPKSVRSTPRTNSSPRSMSLGDATPLYDENI

SEQ ID NO: 11394 - protein, 860 aa, Phyllotreta armoraciae
MPEVDNSEARSPRRKRRRSKSGDRKEEKSSKRKSSRKRSSDDDYNERDYPRYYGEDRPNSDSYWNKYPRRDNMKVGRRYYDHPEHEKNRDRDVSNERSRDRDRESTRGKKEENEDKSVIKPRERKVVDMLTSRTGGAYIPPAKLRLMQESITDKSSAAYQRIAWEALKKSVHGYINKINTSNIGIIAREILHENIVRGRGLLCKSIIQAQAASPTFTNVYAALVAVINSKFPNIGELLLKRLVLQFKRGYKQNNKSICISATTFVAHLVNQRVAHEILALEILTLLVETPTDDSVEVAISFLKECGQKLTEVSSKGITAIFEMLRNILHEGQLEKRIQYMIEVMFQIRKDGFKDHAAVTEELDLVEEEDQFTHLIMLDDVKEANAEDILNVFKFDEHYEENEGKYKTLSKEILGSDSESDTGSEGSEEDSEGEDEDEEVKDAGKIIDNTETNLIALRRTIYLTIQSSLDFEECAHKLLKMELKPGQEIELCHMFLDCCAEQRTYEKFYGLLAQRFCQINKIYIEPFQQIFKDTYATTHRLDTNRLRNVSKFFAHLLFTDAIGWEVFEIMKLNEEDTNSSSRIFIKILFQELAEYMGLGKLNTRLKDETLQQHFAGLFPRDNPKNTRFSINFFTSIGLGGLTDELREHLKNVPKIMETKTASVKEESGSSSSSSSSSSSSSSSEEESSDDSSGDSSSEDEKQKEKSKKKKKKRDSESKSSKSDSKSNRKAEKRDSSKHKKKDKEDHKETHKNKENRSDTDKHVSREKQNSRQDKRKDDGDSKEKHRKDDREDRERQRRNEEKGGKKKDYEWIKSRHEDNIHQLKTSKKVFEKPSKHRSRSRDKISSKEKDRRHRSKERRKS

SEQ ID NO: 11395 - protein, 595 aa, Phyllotreta armoraciae
MALKNQVGQKIMNEVIKHKPSKKNGPAVAQPHNAAGVDWRILVVDQLAMRMVSACCKMHDISAEGITLVEDIMKKREPLATMEAVYLITPSEKSVHALMNDFESPRPMYRGAHVFFTEACPDELFNKLSKSHAAKYIKTLKEINIAFVPTESQVFSLDSPDTFQCSYDPSFAAARNANMERMAEQIATLCATLGEYPHVRYRSDWERNVELAQLIQQKLDAYKADEPTMGEGPEKARSQLLILDRGFDCVSPLLHELTFQAMAYDLLPIENDVYKYEASAGVQKEVLLDENDELWVELRHQHIAVVSQSVTKNLKKFTDSKRMTQSDKQSMKDLSTMIKKMPQYQKELSKYATHLHLAEDCMKAYQGYIDKLCKVEQDLAMGTDAEGEKIKDHMRNIVPILLDTKITNEYDKMRIIALYAMTKNGITEENLSKLGQHASIKDKQTIANLQLLGVNVINDGGPRKKQYTVPRKERITEQTYQMSRWTPVIKDIMEDCIEDKLDQKHFPYLSGRAQTTGYHAAPSSARYGQWHKDRGQQAVKNVPRLLVFVVGGISFSEIRCAYEVTNAQKNWEVIIGSSHILTPEGFLSDLATLAG

SEQ ID NO: 11396 - protein, 712 aa, Phyllotreta armoraciae
MMQQYMKELEQEPFDAEEFVERLAWRTLAESKSDGEENEINPALLHESFVQAIKDLNLLHERQQKKCEKLEVAVREDEATFFQEVYNLLEQNKQAMETFQELDGKINHVATKVLHLGDQLDSVNGPRSRVVDALSLMTHLREFLSNEPVSSTIFTNEKYIDEAADVIQKLYLISQDLPPKFESIKRKIERKYSDIEKTLIEEFVGAMDNENLTRMKEIALVLSQFKGYSQCIDAYIDHSQVGCLSSKDVFYNFLNLCKYKDEIIRKVFKNPEQVMAKFVLNIYQLKLVEYIDQKLNSKLGTYSYLQTLYELYSKTNHLSNELAVFHMGNDKNFLTKLTTNIFNKYINDYISMELKCLKDRCSTNLQKYYDSKNHQKKQIQSGGFQDLRRDLQAVIGTRANINIAQIENYGGETFLSEELAIMILQDTKQAFQRCLLLSKGSEKASNATQILDRLINSLLIEHVDYAVELGLQAVPVVEGVKNPPVLYFFNVVHQSNNITHLVEKQFMDLVVPLVENTPKYSDCVQKKKFVLEDIERKINTGLDRCLSAILNWVKLYLQSEQKKSDFKPESDDFDTVASSACKNVLNYVNGIIKEIKTNLDGNNVTAILQELGIRLHRVVYEHMLQYQYNTAGAMVAICDLNEYRSCTKQLGPLVAELFDTLHALCNLLLVKPENLQQVCSEDSLGKLDRAILHSFIQLRSDFKVQKQTMLKV

SEQ ID NO: 11397 - protein, 270 aa, Phyllotreta armoraciae
MDFQNRPGGKTGGGGVASWSETNRDRRERLRQLALETIDLQKDPYFMKNHLGSYECKLCLTLHNNEGSYLAHTQGKKHQANLARRAAKEAKDAPSLLQPEKPRVEPKKFVKIGRPGYRVTKQRDPETGQQSLLFQIDYPEISDLVLPRHRFMSAYEQKIEPPDRKWQYLLFAAEPYETIAFKVPSREVEKTDTKFWTHWNRDTKQFFLQFAFKNENKRSVNSVVQRHSIVGGVPPPPMLPVPPPPRPPMFNPIPPPPPMMRAVLPVPPPN

SEQ ID NO: 11398 - protein, 133 aa, Phyllotreta armoraciae
MSIGVPIKVLHEAEGHIITCETITGEVYRGKLIEAEDNMNCQMTQITVTYRDGRVAQLENVYIRGSKIRFLILPDMLKNAPMFKKQTKAGTAGRGKSAILRAQARGRGRGQPPVRGGRGAWQNQQNAPAGRAK

SEQ ID NO: 11399 - protein, 442 aa, Phyllotreta armoraciae
MATNLSRTSLLRILNARGYSACPHPLSGIPNAEVKSTVLPNKTVIAAVDNSASLTRVSIVFRAGSRNEDPENLGVAHVLRTAAGLSTRNCSQFAIIRNIQQVGANLTATSDRETICYTLEGTPEAVECAIPFLTEVATQQEFRPWEVSELSSRLQLDIATRPLQLRAIDLLHNAAFRGRGLGNSLFIPKTQIGKISSETLQHYVSSNFLSGRMAVVGSGISQKELTSFANSLKVENGEGNNAPSPYVGGELRSNKGGQLAFIAVAGEGAALKNHKEALAFAVLQGALGGGPQVKYGVSDNGIFRKALGNNPSVSSVAINASYSDTGLFGLLLAVPTNSARSALESAVKVLKSGSVSDEDVSRGKNQLKASILFNAESGADIVRTIGQEAVLTQKVTSADALLAEVDAVSTSDVANALKKAGKKLSLASVGNLAGVPFLDELK

SEQ ID NO: 11400 - protein, 110 aa, Phyllotreta armoraciae
YNQQLHGSTSSNYLLPVSNRSSSSLSNHRTAEELESQNDEAIDGLSAKVKMLKEITVGIGNEVKESSKLITGINDSFSEASGILSGTFRKMNRMSKKHTGRWYYWLLFLV

SEQ ID NO: 11401 - protein, 496 aa, Phyllotreta armoraciae
MSFPSTINAKQAAHEHVLAVSRDFVSQPRLTYKTVSGVNGPLVILEDVKFPKFNEIVQLKLADGSLRSGQVLEVSGSKAVVQVFEGTSGIDAKNTMCEFTGDILRTPVSEDMLGRVFNGSGKPIDKGPPILAEDYLDIQGQPINPWSRIYPEEMIQTGISAIDVMNSIARGQKIPIFSAAGLPHNEIAAQICRQAGLVKVPGKSALDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHSDVSNQLYACYAIGKDVQAMKAVVGEEALTPDDLLYLEFLTKFEKNFITQGSYENRTVFESLDIGWQLLRIFPKEMLKRIPAATLAEFYPRDSRH

SEQ ID NO: 11402 - protein, 504 aa, Phyllotreta armoraciae
MNEIRERERAGIRVPDELRAMLLEFTCSYLLEQPEDVVSYAQEYFTKFKESRGTALIYDQDMYDQETMGIKMGIKTVLARQIFDSRGNPTVEVDITTDLGLFRAAVPSGASTGIYEALELRDNIKTEYHGKGVSQAIKNINTIIAPELIKAGFEETQQKKIDEFMIKLDGTENKSKLGANAILGVSLAICKAGAARKNVPLYKHIADLAGNKDIILPVPAFNVINGGSHAGNKLAMQEFMILPTGATTFTEAMRMGSEIYHHLKKVIHAKFGLDATAVGDEGGFAPNILNNKEGLELIKVAIQNAGYTGKIDIGMDVAASEFFKEGKYDLDFKNPNSDKSKWISSDELEALYQEFIKEYPIVSIEDPFDQDDWAAWSKLTGNTKIQIVGDDLTVTNPKRIQTAVEKKACNCLLLKVNQIGTVTESIEAHLLAKANGWGTMVSHRSGETEDTFIADLVVGLSTGQIKTGAPCRSERLAKYNQILRIEEELGAGAKYAGKAFRKPQ

SEQ ID NO: 11403 - protein, 806 aa, Phyllotreta armoraciae
MSYMQTNQNRPMSQGYHQGGNDLPMQSSKEQTLLWQQNSYMGDSGIQSGAATQVPSLSGKEEEEMDLFDLDQPYQGFTQEQVDEMNNQLNHTRSQRVRAAMFPETLDEGIEIPSTQFDPNHQTAVQRLAEPSQMLKHAVVNLINYQDDADLATRAIPELIKLLNDEDQVVVSQAAMMVHQLSKKEASRHAIMNSPQMVAALVRAISNSNDLETTKGAVGTLHKLSHHRQGLLAIFKSGGIPALVKLLSSPVESVLFYAITTLHNLLLHQDGSKMAVRLAGGLQKMVALLQRNHVKFLAILTDCLQILAYGNQESKLIILASQGPIELVRIMRSYDYEKLLWTTSRVLKVLSVCSSNKPAIVEAGGMQALAMHLGNPSTRLVQNCLWTLRNLSDAATKVDGLESLLQSLVQVLQSSDVNVVTCAAGILSNLTCNNQRNKVTVCQVGGVDALVRTIVSAGDREEITEPAVCALRHLTSRHVESEMAQNAVRLNYGIQVIVKLLNPPSRWPLVKAVIGLIRNLALCPANHAPLREHGAIHHLVQLLMRAFQDTQRQRSSVASGGSQPPGTYADGVRMEEIVEGTVGALHILARESHNRAIIRQQMVIPIFVQLLFNDIENIQRVAAGVLCELAADKEGAEMIENEGATAPLTELLHSRNEGVATYAAAVLFRMSEDKPQDYKKRLSMELTNSLFREENLWNPDLGMGPDLQDILSPDQAYDNMYAQGPPSVHSSHGGRPYQQQGYDQIPIDMQGLEIGSHGGGNGSTYSAIDAMDVTSGEPDLNFDTIDQLPTPPQDNNHAAAWYDTDL

SEQ ID NO: 11404 - protein, 266 aa, Phyllotreta armoraciae
MARNAEKAMTTLARWRAAQLGEIDKHKKRRPYLASECKSLYACEKWRMQIIREIAKKVAQIQNAGLGEFRIRDLNDEINKLLREKRHWEDQIKELGGPDYQRVGPRMLDHEGKEVPGNRGYKYFGAAKELPGVRELFEQEPPPPPRKSRAELMKDIDADYYGYMDDDDGILIPLEVKAEKIAVQNAVSEWVSNKEKNLDSSKVIEESIYAVEDSDEEDAVQQFDGSQQRFVAHVPVPSQQDIEQALLRRRKQELMEKYGVQDEQDV

SEQ ID NO: 11405 - protein, 214 aa, Phyllotreta armoraciae
MAAKDMPTFKCVLVGDGGTGKTTFVKRHMTGEFEKKYVATLGVEVHPLVFTTNRGKICFNVWDTAGQEKFGGLRDGYYIQGQCAIIMFDVTSRVTYKNVPNWHRDIVRVCENIPIVLCGNKVDIKDRKVKAKSIVFHRKKNLQYYDISAKSNYNFEKPFLWLARKLIGDPNLDFVAESALLPPEVQMDPQWQKQLENDLKEASETALPDDDEDL

SEQ ID NO: 11406 - protein, 834 aa, Phyllotreta armoraciae
MPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEEGEDAVDDPRKLKPGEIDPNPETKPARPDPKDMDEDELEMLSEARARLANTQGKKAKRKAREKQLEEARRLAALQKRRELRAAGIEVTSRRKKKRGVDYNAEIPFEKQPAIGFYDTSNEALDLMAPDFSKMRQQHLDGELRSEREERERKKDKQKLKQRKENDIPQAMLQNEEPAKKRSKLVLPEPQISDQEMHQVVKLGKASETAREIATESGVETTDTLLNDYMFTPQAAATPRTPAPQTDRILQEAQNMMALTHVDTPLKGGLNTPLHNSDFSGVLPQSQAITTPNTVLATPFRSSRSDGGATPGSTAGFMTPKSGALTPVGKNATPSVRDKLNINAEESLDVASTPAEHRMYQMSMKDQLKLGLSSLPQPRNDYEIVVPENEAQDEPEEAQSQLVEDQADIDARKQEELRAKAAQELASRSQVIQRELPRPQEVNLTVLRPPNESYSLTDLQRAEELIKCEMVTMLQYDNLKNPLPAQSKRSNMSQAQQLAFLEQHPYDSFKQEDLEVAKTLLRSEMDVVKSGMNHGELPLDVYNQVWEECLSQVLYLPNQTRYTRAHLASKKDRLESAEKRLEQNRSHMAKEAKRAAKMEKKLKILTGGYQSRAQVLIKQLQDQYESIDQSTLELNTFKFLAEQEKNALPMRIQSLTEDVNRQMEREKVLQKKYADYQGQIKQLQEEYLVQMQNVPNEESIKYDEVTSTTNEENGMDTTENDKITAEN

SEQ ID NO: 11407 - protein, 157 aa, Phyllotreta armoraciae; identical to SEQ ID NO: 11072

SEQ ID NO: 11408 - protein, 416 aa, Phyllotreta armoraciae
MYGLQRYSFGYTLKNAVRYYSREPAKRSSFLSRLYDNFKDEMAKNKEMKESLKKFREEAQKLEQSDALKAARQKFETVEKEASKSGEVFKESLGSIKERVKGVIDEASKSDLAKKAGKFTEEVGKTTHKISETAQEISKTGAFQSISEATKAVKQEIDNTSMEGRVYVSPKKLRKRTETSAVVQQKYYEPNTDATGVELHKDSKFYESWQNFKNNNPYVHKVMDWKLKFDESENPIIRASRALTEKVGDIMGGLFQKTELSETLTEICKIDPAFDTKRFLKQCETDIIPNVLEAMTRGDLEVLKDWCHEGPFNLFAVPIKEAYKKGYRIESKILDVDHVDLVMGKVMDQGPVLIISFTSQQVMAVRDGSGAVVEGDPDKVMRVNYVWVLCRDVVEPDPRAAWRLLDLSASSNEQLV

SEQ ID NO: 11409 - protein, 302 aa, Phyllotreta armoraciae
MSSSDSELSDSDAELQQALLDGKLKPGLNKIEEAPKQFVNNISGLNQKIEEFKLKLPWIERLDCTNAQAPLAPELAAEMLVHEEKRSNQLRNNKKLPQFQPAQDPVLNDFKRELIFHRQAQATILEAIPKIKELGILTKRPDDYFAEMAKSDEHMHKIRENLKQKQEQQKRIERVKQLRQQRKEGKSLQVQMKLQRSKEKKEMMDQVKKARKNFDFLDDKNKPMGRKAAEKRKMKDKKFGFGGKKKGMKKNTKDSAGDISEYKNPGKPAKKQMGKKFVNKNKPKNQRMGKNRRIKTKAKGRK

SEQ ID NO: 11410 - protein, 511 aa, Phyllotreta armoraciae
MNPGAPNYPMASLYVGDLHSDITEAMLFEKFSSAGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDESGVSKGYGFVHFETEEAANKSIEKVNGMLLNGKKVYVGRFIPRKEREKELGEKAKLFTNVYVKNFGEDLSEEQLRTMFEKYGKITSYKIMSKDDGKSKGFGFVAFESPEAAETAVEALNGKEILEGKPLYVGRAQKKAERQQELKRRFEALKMERLNRYQGVNLYVKNLDDTIDDERLRKEFSPFGTITSAKVMMEEGRSKGFGFVCFSSPEEATKAVTEMNGRIVGTKPLYVALAQRKEDRKAHLTSQYMQRMANMRMHQMGQFIQPGGSSGYFVPTIQATAPRFYGPAQMPIRTSPRWPAQTPVRPGAQGSTATYTGMPNSYRAAARPPGQSTMRSNISVPRPITGQQPPSMHGRPLVGQGVAAAGNRAANFKYT

SEQ ID NO: 11411 - protein, 921 aa, Phyllotreta armoraciae
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSGLVEDQGFLEQLKELLSDSNPMVVANAVAALSEINESSPTGQPLVELSTNTINKLLTALNECTEWGQVFILDSLSNYTPRDEREAQSICERITPRLAHANAAVVLSAVKVLIKMMEILAGDTEFCNTLSKKLAPPLVTLLSSEPEVQYVALRNINLIVQKKPDILKHEMKVFFVKYNDPIYVKLEKLDIMIRLASQVNIAQVLSELKEYATEVDVDFVRKAVRAIGRCAIKVEPSAERCVATLLDLIQTKVNYVVQEAIVVIKDIFRKYPNKYESIISTLCENLDTLDEPEARASMVWIIGEYAERIDNADELLDSFLEGFGDENAQVQLQLLTAVVKLFLKRPQHTQGLVQHVLSLATQDSDNPDLRDRGFIYWRLLSTDPAAAKEVVLADKPLISEETDLLEPTLLDELICHISSLASVYHKPPTAFVEGRSAGIRKTLPARQGSDEGAAAAETTVIPNQESLIGDLLSMDINAPAPSAAAAPAAPQTSNVDLLGGGLDVLLGGGNDIGGAPASAAAPTTTGLLGDIFGIPTAPTMYTPPKVVWLPAEKGKGMEIYGTFSRRSGQMAMEMTITNKAMQAMSGFAIQFNKNSFGITPSSPLNIPTLQPGQNLEYSLPLNTTGPVQRMDPLMTLQIAIKNNVDVFYYACQIPIQILFGEDGTLDKRVFLTTWRDIPGANEVQYTLNDIKGNTDTVSNKMTLNNIFTIAKRNVEGQDMLYQSLKLTNNIWVLLELKLQPGVPTATLSLKSRSVEVAPYVFQAYESILKS

SEQ ID NO: 11412 - protein, 165 aa, Phyllotreta armoraciae
MPPKFDPTEVKYVYLRCVGGEVGATSSLAPKIGPLGLSPKKIGDDIAKGTADWKGLKITVQLKIQNRQATISVVPSAASLIIKALKEPPRDRKKQKNIKHSGNITFDEVISIAKQMRHRSMAKSLAGTVKEVLGTAQSVGCTIDGKAPHDVIDEVNEGTVEVPDE

SEQ ID NO: 11413 - protein, 364 aa, Phyllotreta armoraciae
MSEEGKRALILVGGYGTRLRPLTLSRPKPLVEFANKPILLHQIEALVDAGVTEVILAVSYRAKQMEEELTVEAAKLGISIVFSHETEPLGTAGPIALAKEHLSKSTKPFFVLNSDIICDFPFRELEKFHEGHGKEGTIVVTKVEEPSKYGVVVYDQNNCIESFVEKPQEFISNKINAGLYILNPSVINRIELRPTSIEKEVFPYMASDKQLYAFELKGFWMDVGQPKDFLTGMCLYLNHLRETNSQKLYKGPGVVGNVLVDPTAKIGSNCQIGPNVTIGPGVVIEDGVCIKRSTILRGAVVCSNSWLESCIVGWKCHVGKWVRMEGSTVLGEDVIVKDETYINGGQVLPHKSIATSVPEPQIIM

SEQ ID NO: 11414 - protein, 285 aa, Phyllotreta armoraciae
DGEEVISDQEKVKIVSDFILHSPPGEFNEVFNDVRKLLNNDDLLKEGVTGAFAQYNKDQLTPVRIENADQMVLITEYNDLGNNRFFDPRSKQSFKYEHLRKEASDYQPYSVDTTAEPWRAALDNEFIQYTRNHYKDGVCSVFGRSQNGAITLTACIEDHQFQPKNFWNGRWRSQWSVSLTDESTAEVRGVLKVQVHYYEEGNVQLVSTKEIKESIPVSNEAQTAKEIIHVIENAENLYQTAISENYQTMSDTTFKALRRLLPVTRTKMDWNKIVSYSIGKELKTQ

SEQ ID NO: 11415 - protein, 1371 aa, Phyllotreta armoraciae
MLVKMNFLLVLTISAVAVGAQEGAAPAVASQDNTGDVESIDVGAAGSDVGEDSRPVPVGENDGPVTNSPSYDAPVEVLTNIDSETIDTNSSRPNWTFQKKTKSGKYVTYYAANYDPMTSDTAPPDTDQRGGGIPYSITENRLAEIRKNFMYPYFDKGGNVDNEGDYQKEIQSSTPQVHKNLNFQVPFFGFRYNYTRVSINGYLEFSDPPSNLNYPLVFPIKDWPKQNDPSFIGIFYSKCKIGNLRDEDVDKRKPGVYFRMERDLRDRQDRMGVEIRERLKWDIREGVIGSDTFDPKHAIIVTWKNVSFNGGYANAVYQTNTFQMVLATDEVFTYAIFNYLNLAWTSHTEAGGDTRTGEGGVPAFVGFNAGNGTRSFQYAPYSQASVIRDLVSTGWGNNKPGRHIFRIDENILLGSCNKDIDGANLPLQFAPESGNMLGGTVVNITGPCFNPNDRIRCKFDVYDEVVGYVVDRNRAICIQPRLYSEGWVRLQIAINSDAFKWKGKYYVESPASASQKIFFKDMKYHEKSPSEIRITWQKQNLTTNENANIRISLWGYRETTMRPTFVYITDIADNVQNTGEYTIVPSQYRGKINQYLSDIKFGFLQINLTESIEVNTYSTNNQNIKITPIIWSRPIPLGWYFQFQWENQYGKNWPKYLCDDWLRTDRYLKNFAHELPQCPCTVQQALADKGKFMPDFDCDKDSNPVCYYNNQALHCVKTGAPTMEGSEQQCCYDKNGYLMLSYDQQWGSSPRRCHNLGKMPYNEATKVPTLSQWFNDVVPKYLCCLWQEEQAVGCETLRFERRPSQDCVAYQAPAVAGVYGDPHIVTFDDVEYTFNGKGEYSLVKSVKVDDNLEIQARFEQMGTNAYGEVRATQLTAIVAKGNKTIPIEVRRRPPEARWRYRLDVIAENRRLFFDRPSLKFQHFQGVTVYTPTYILNQSEVLIMFDNGAGVEVLDNQGYMSARVYLPWSFINKTVGLFGNWSFNKEDDFTLPDGSKAAVASNINDMERVFNEFGSKWMLDDVADANKGQSLFYREFGRTSATYNNKTFRPQFLMLPEDILPANRSEQIQRTYDVCSTKMYECYYDYAMTLNRDLAHFTQNYKATIYELKQTTREKITSCGVLETPRFGRKSTFLFVPGTKVTYECIQDFVLVGDPRRECGADGKWNIPDFGYTYCLRQEEYSSRQAAIASGIVLAILIPLILLFLYLGYKIYKRLFANDDGSWKYQSAAQKSSAPPTFRRSFSPYRDEDDDDILRSPSDGDTLPKKRRSYEKSYRTHEPLTDRPSIDFEDKPLDPNDPSYDDIDRTSAALSSPASPTSPTSSVQYTTPYNARPDILGNGNRNLEYAENDYAMPVKKPKNRFSQSQSSIVTDV

SEQ ID NO: 11416 - protein, 113 aa, Phyllotreta armoraciae
MRYVAAYLLAALGGNASPSAADVEKILGSVGVEAEAEKVKKVLGELNGKSIEELITKGREKLSSMPVGGAAPVAAAAVAAAPAAAEEKKEAKKEEKKVESESEDDDMGFGLFD

SEQ ID NO: 11417 - protein, 907 aa, Phyllotreta armoraciae
MMTDRFGLKWDPKNLEIRTMSVEKTLEPLVLQVTTLVNTKGPSKKKKGKSKRANALVSTVEKATENFIEKGEQIAYENPDITDEMIAAVEEVRKTGNAMSIAAREFSEDPCSSLKRGNMVRAARNLLSAVTRLLILADMVDVHLLLQSLHVVEDDLEKLKNASSHGELLDNIKAFGHNANELMNQAAKRQQELKDPQLRDDLAAARAVLKKHSTMLLTASKVYVRHPELAAAKANRDYVLKQVCEAVNTINDVAQGRTPQPASGPYDGPGELAAALDDFDDHMVMEPLAYNEVHTRPSLEERLESIISGAALMADSSCTRDERRERIVAECNAVRQALQDLLSEYMTNMGKKDKSDNLNRAIDNMGRKTRDLRRQLRKAVVDHVSDSFLETNVPLLVLIKAAQNGNEKEVEEYAVVFTEHSNKLVEVANLVCSMSNNEDGVKMVRYAAAQIDNLCPEVINAARILAARSRSKVAQENMEAFKQSWENQVRILTEAVDDITTIDDFLAVSENHILEDVNKCVLALQEGDADTLDRTASGIKGRSNRVCNVVTAEMDNYEPCIYTKRVLEAVKVLNDQVMPKFTQRVQVAVQALGNSPPKEVDENDFIDASRLVYDGVREIRRAVLMNRADEDLDPEDVELDENYLIETRSKSSAHTGEHGVDEYPDISGITTAREAMGKMPEEDKQKILQQVEFFKNEKLKFDNEVAKWDDTGNDIIVLAKHMCMIMMEMTDFTRGKGPLKTTMDVINAAKKISEAGTKLDKLTRQIAEQCPESSTKKDLLAYLQRIALYCHQMNITSKVKADVQNISGELIVSGLDSATSLIQAAKNLMNAVVLTVKASYVASTKYPRPGTVASPIVVWKMKAPEKKPLVRPEKPEEVRAKVRKGSQKKVQNPIHALSEFQSPTESV

SEQ ID NO: 11418 - protein, 262 aa, Phyllotreta armoraciae
MQIYMFDFLSGTPLFGVAPTSSSTTTIASVPALGLSTTVSSAASTTPSTSLGTTTAAPPAYSTSTLPSSGSLTFSQLEDSINKWTIDLEEQGKFFINQAKQLNAWDSLLISNGEKILNLNGSIERVKQQQQQLDQELDFVLAQQKELEELITPLEKELLEIPVTDIDRNQMYQFSEIIDSQLKQMSDDLKEIIEHINESNKSEEISNPLTQISRIMNAHMNSLQWLDRNTAQIVSHLEQISKMQDSNRRNFPLNHSFNNSLL

SEQ ID NO: 11419 - protein, 193 aa, Phyllotreta armoraciae
MFIWDWFTGVLGYLGLWKKSGKLLFLGLDNAGKTTLLHMLKDDRLAQHLPTLHPTSEELSIGNMRFTTFDLGGHSQARRVWKDYFPAVDAIVFLIDANDRSRFVESKQELDALLTDETLANCPVLILGNKIDLPDAASEDELRNVYSLYGQTTGKGKVARSDLPGRPLELFMCSILKRQGYGEGFRWLAQYID

SEQ ID NO: 11420 - protein, 233 aa, Phyllotreta armoraciae
VNVTCHYCQHQPKTYIFLIKISLIQLILTSNFDKKSKRTDTASLSVMDPIAVLEKRIEALELQVFPLGDYNQISNKTLTITNLLVETQTMINSALTCRESITSMLQHLVVINDYLNPVSEADELEVEAKRQYLLELYPELKDTIQTVSTLESLLPFIDSINISKVVEFSGKLEEVAVSNLKLYGECRDITKKVLVALQQYNDISNSIKLLFSQLDTAVTNLEYALQLRDANEE

SEQ ID NO: 11421 - protein, 583 aa, Phyllotreta armoraciae
MNNAKLQEVYSDLTLYTTPDKFFIEPKAGEELMVIERNSENIICFKSDHRHLIPAANSRKDFCGLIGIIQLLACPYLVVAVQRELVGYIAGCAIWRLAKAELIPYRSSAHLTPEKQADNDVYLSMVYSVLSTPFLYFSYDYDLTHSLQRLHGISPDFWKQSLFERADQRFVWNGNLLYSFKGFSIHRFCLPLMHGFISINFCVVNGHSLNWSIVSRRSIQRAGTRLHRRGLDKEGNVANFVETEQIVEYQGDRASFVQIRGSIPLFWQQDPDLRYKPPPTILDVDPQDQHSMCLKHMNDLMTFYGKVVCVNLVDQKGAEGNMETAFKNAIANVSSPSVKYESFDFHAECSKMRWDRLLILIDRLAHDQDEMSFFLLLRDGSLSSLQDGVFRTNCIDCLDRTNVVQSMLAHRNLESVLRKLQILHQNQTLEFQYSFEVLFKNVWADNADIISTQYSGTGALKTDFTRTGKRTRYGLLQDGMNSLTRYYKNNFADGLRQDAIDLFLGNGKPISPLHIDKGWKYVTYPSILLIAVAMFVACAVTPSEYSTDSLLFLLFWGSMVYATLHTILKYGSEFVDKPRLTHS

SEQ ID NO: 11422 - protein, 495 aa, Phyllotreta armoraciae
MPPTIQQNNQNAANGVEKRQVKTVEKRSDLLCKVKYCNTLPDIPFDLKFITYPFESIRFIQYNPTSLERNYKYEVLTEHDLGVSIDLINKDIYAIGAGAALDPADEKLLEEDILTPQDSKRSRHHAKSVSWLRRTEYISTEQTRFQPQTMDKVEAKVGYSIKKSLNNETLYMDRDSQIKAIEKTFEDTKTTIDKHYSKPNVVPVDVLPVYPDFSLWKYPCAQVIFDSDPAPVGKQVPAQIEEMSQAMIRGVMDESGEQFVAYFLPTEETLQKRREDVANQVQYQDEEEYEYKMAREYNWNVKSKASKGYEENYFFVVRSSGIYYNELETRVRLSKRRQKVGQPPSNTRLIVKHRPMDANEFRMQRYREKQLEPTGEDDEEMEIDEPQDEENVLEPDNESRDKETESDNEKKRSRASSVSSQRRSRSRSNSSAKSNSRSSSRSLSKSRSRSRSKSSSRSRSRTPSKSPSRSRSVSKSPSKSRSPSPCQIRVVASTN

SEQ ID NO: 11423 - protein, 389 aa, Phyllotreta armoraciae
MPIENLEDQGLEKNPDLELAHYKFLLTLPEYRSDRNVHSKITEAIKKDDMAPWYELLCKEVGWKLDSALLKALKAKNAEKVKLLDEAIEDAEKNLGEMEVREAYLRKAEFYSRIGDKENAVSTFRQTYDKTVSLGHRLDIIFHLIRIGLFFMDHDLITRNIDKAKSLIEEGGDWDRRNRLKVYQGAYCMSVRDFKTAANLFLDTVSTFTSYELMDYKAFVRYTVYTSIISLPRNQLRDKVIKGSEILEVLHSEPFVKDYLFSLYNCQYAEFFSNLAEVETILRKDYFLNPHYRYYVREMKISAYTQLLESYRSLTLQYMAEAFGVTIEYIDEELSTFIAAGRLHCKIDRVGGIVETNRPDLKNAQFNSVVKQGDLLLNRVQKLSRVINI

SEQ ID NO: 11424 - protein, 5126 aa, Phyllotreta armoraciae
MEELTSGLDPDDLMDLDEPEGSDLEEDDEDLIDDHVSSPFISSSAPESTANSVASSPIHEDFPPPFNFTGKPLHVKRGRGRPRREGGKPSAPRTTRGGGTGVSRVRRPRPPGFSRRGSLGGSRSVRQVDRSDYEMSLFAGSPVDDGLLDPETGSMIFPEKFVPAIEEPPYFPEHWPGKVCALCNLGERSQLGQGEMLRLNCPEGFSPEKVISEQILERALQAPDKECGDKSPKGPVTCRRQKSFNKCRHPSITSEYVDELTIIGYNEVPDVSSLFEPNGQFYVHRNCALWSNGVTKAENSALLNVGPVVSQCSSKKCSFCNHYGASLTCHVDKCTKIYHFPCATAAGAFQDVSSLTTLCNDHLGQVAVLTNASPCLTCASMGDIANLMFCSGCGAHYHGICVGLAQLPGVRSGWQCRKCRCCQVCRVVGDESKLMTCEQCDKIYHASCQRPIVTSIPKYGWKCRCCRVCGDCGARTPGAGLSSRWHAHYTVCDSCYQQRNKGFSCPVCHKAYRAHAHREMVQCSSCKKFVHGTCDPEADVVTYSQKKEISVDYEYVCLHCKNSTARQITAKRASIDDPSDVSASHDSLYDDTSELDLPSPDEFARNMGLGKGKPYSANKIAKKRLSFTVNPVGRPKGTGKVPPGKMGFMKRYRLTEFNRKRGPKAKMRGIFGVPGVGLQRPISDGKTDEEPGVENRLVLCSAKDKFTLTQDICVMCGAFGTDQEGCLISCVQCGQCYHPYCINVKVTKVILQKGWRCLDCTVCEGCGQRNDEGRLILCDDCDVSFHIYCMDPPLDYVPHGNWKCKWCAICQSCGATDPGFNCTWMNSSTQCGPCASHVNCPSCNEPYGEGDLIIQCVQCERWLHGACDFIKCEEDAEKCAEEGYNCILCRPRDVPPPHMVPAAVTPKPPTPTKSPELGKSTSYYMDGVCLSEFGSNLIKSLALEYHGSRKKRKKIPTVQDKEAGIMATIESVVAGGNIIPTNMEDSAKLELVDIKDEPQELYKEGMMWTKEDGPPPEGFTIITMENGLNVLRRKRQRNLQKLGIGGFVVRMRGIRTGQDNDDVDSTIGQSGLNANDIVPSPADVDKPRRKAIRRKPKSKLAETFPAYLQEAFFGKDLMDTVDCKKEEVDCYSSDEEKTDKHYKSINLSQDEIIAIVASGKTEKLENNNKDSTKEVKPTVLKEEEEDNPEDLKDVLALPGDLLDTDLVNSIMEDEEELSKTTASLVALDSNLPHDTELTDTLSSSGNSKETKDELSDILGPHFNLDSISNINSKDVEDIFKGVLTDESQESQESSNFSLQGNSMFSNNNAQQTVAQHPIINQPVRPKTLPTVNHNLNSPVSFPPPSPYHSEYSNSPQFSPAFTESSCSWVSGNETPEIDSTNVTVTSTYNQRSSDKMKADESLGKSATISAVLYANINHPEWKKEYPNWPDRYKQIIKKWRTLSQEQKAPFLQHARDNRSQLRMKKAQQSQTVKETASAATSPNASKPLHQAGQALVTTLQAVTQQPAGVPAAPAAPVSEDQEKIALQQKSAREAEQERQWKQLQALRQQQTQQTQNILHEQRVQAIARVQRQISTDPAQQFINEQQSPLQVNTPQELSPSTTPAPSPRQFLGIKSPTFPVPSPIQQTSVRANTPSQSPHDVSQPSTPDGNDHFIHSPTNPKPNFQPRLPNDPFAAQPATPRPQFGMARPPLQNFGGTVRNEQQDININRQLRELLQRQQVKKLDELLPGKAPPQRLWHANDQQEGSDASMTSPVAQGAQSAQGADATFRQPLPPGVVKPRLAISSVNRPILNAVRVNQLDPRIQNLDPRMRLILQHQQQRLATGIQQQFIRFTSNVRPTTVEQYEQLLQRQGNNQNQIHAEEQQQGVARIPITQASVIQRPHVAQAVVTGAAAATNSSTESNPSEEGIPDNVTAELEKLEQETGTMVELQGVSDILGGLDDDDELLAEMGADFNILEYADPELEALTGGKTNILDLELEEEPVKKEKLASNANTSAPSQKPTPNVATTATSNSTAVTTPTEANTEPKIDNTIQQNIPKTVQAAPQQLQHPASLPQQQNMPQHGAQVQVQSQQSQPHPPQQMPIQSTLHIQQIHQQMVHQVQQAAAQGRPMPPGSKMQTTDGFVGVVMANNAVQLQIPPNYQQRLLLLQQLQNQKLMRVGSTQPRAALQVAPNQIPVGMNPGPRMPVSAPPPPPPPYPGPPPPYPGNANQHQQEQPLLLEDLLEQEKREQEKLQNQPPNHEVTSSTGNETESALMSDQDFERLKADVFNSAPVNNISSTNQGNAGQTSQAWPQLQNRQAVVPAAASQHTMEVTTRVQMFNPNLVPAPPLPPENIATEQDKQAQLLYEQWLNHQNNTLVQQLRYYETEVQKLRKSKKSLNSKQRQLRKAGNQLTEVDATELQRITAEQAILQKHLESSRKQNRQHGMLIQEYRNKHPAIKQRTGTDQIQSPLGHPASSPIQQSSASLSPMLSPSVSPMTQNSSPLNSPGPMVPSSPGHGPVQNILQSPNGANAAQMSPMQSSPRIGTPHSQSDESPGSAQSPSQVCLPPPMPRMTSPQHRRVVTSPVGMSQMRFINNNMLQQRVRMQSPIQNFQQKPGTPSPLNSPTSQQMSVNQQHQIQKQLQQQQQQQTLLQQNLEGDPNAIHSQRTTQLLQHRNFIRQQVSQQQISPQTLTPQQHQLMLQQQKQLAQQQQQQIAQMNAARLQQQQQQQQQQQNNPPHSPMPPKSPMINQQIMSPHSMPQSPMQMPPKSPMVPFNPNQNPNSPAARSPAFHQGINQPTSPITHGHQPPSSPMPRSPMINQTHSPHNVRRPPSANSSPAMPDRPHSVENSSPRMYSIDQLVQESLANQNVNAQYNYASDMINESGGGNSNNPIPCPPEIPRFRYFKLGLRGGAPMWSFGRGAKRIPAPPNAKPDEPKAKKESHLSKVSILKRKTSIGSIGKVGSLVSSDYNDLDDSSTTPPVTPPLASTSRGMVSKKKNLELQAQKESVIVMHSPDDNKQLEIMDYDDDNNTVLSSEVSLSSAARNDDDLVEIETISQDLAEGLSSPLESDQIGDEFLLFPGNMVVDMSGEGHYSEKEEEETEEFTDQNMHIVIRSPTTSDDEFIMPCKVKQYNEDEQEDNPESPDQEEFGESSDMLTGYDNEETDIILSDQTTSVPEDSISTKEDFEELIDEGSRKNNISKQEVTAKHIQDFHRYTELFDYGKPDTQTAKKPVTKKFQPKVSVVRGVALPSKPNTEKIIITQNSNVLNTSQASKVTSIILTHNANVRRNIISVPKIVSTVSPAITIVSASTSQMASILPSKFTVPVISASAVRQLSNVKVIDKPSSSSLSISTRDNVLPKKIFEDDSVSPDSSNCEDEKSKDSFDDKVKSESPPQEIKQPAFVKSDANPQVISLKSKNYSDQSKKIEHLQIVNISSKDVVQRQRIPSPMISKASPVIIHNTPELKMTAQVIQESQTRMKITTTTDTEHYDESTDDTKSVVISIPSPTPSQEQMLDSIAFQALENRRREYDSIEDVLDMIENIENITAEPPEILEENTLQSSDSNSNIENKNTETKELQLPTSESEPSVTKSSIVPQLSPLSQPTELTTNMANASQQLRTLLSSLQTTSTSSPTSVESIAKSIGQKIITSSSANQPIVASRVISQQAGRQSPVVTSVSTVIVPNFKQKITVTATSTSRSSPVKVVTTSQQLAGSIITSTLNYLPNRTIGIQMVPEQSKLPPASIVTTMQQINSITSSQESKKPSLTLTAMLQNQPAANMMTKSSADTITAASLLGSPISLPKTGFTTSLVQAQPSVVLSNIPPAPSQPSAVTKTTADSITAASLLGNIAKSSFSMQPSSTVGVATSCPNKTPTSTTNLLHTQLTKVVRSKSVDDVKELAKIDENKPNVSNENVDDSSNSGCKLSQLTTAVCNKTEDSQNVLLKKLLQNTACASTQSSPPASTSIVTTSAANAISKVANSSSNASVEQPPVSAPSIVPIQRSASRDELLSPPQDVQTMIVIKKEPPLVPLSQPSPVMNSNLNAHTPEVKKEFIDESSQHSEVSDHSRSDAPIKEELETMENAAEKMLLDKEELKKQKRRMYQQKRRQNQILNKELAQQQPKKRPRKNSKIDEDYDTYIDGVLAQLRQLPPIQVSEPVLNRNFGVVPLFGCGDLSKIGAKDYSTHLGELTGSYGYGELPGFTDFYSTKPYGDMDPLPEKPPSSTQRGFYDQEFPLIRFDADEHKKFDVFCREDSPDSILSSSSPECTREPETKFVGLKLISDSEEDEEDDAKEAVAKGRMSPVVPVIKPVPIRLKPAGELYFKESLNENKENINSDSLHVMTKSKFDNKQSPPANVSGHVTVTLTLTSSAAEDIMGVLRDLANILHIPAPTSYQIVERTASPPSQKLGLYRTKGKDGKEGAPIDIQSILNGATKFCKHCDVIILSNIIRRKVSDLPFLAKDSDLLSDGEELFFCSSACYMQFALMHRSPSISEDKAAEIINHLSQKDNLDSKQKLSSADSLDSNKSIAQKLSFNIKDSKREFEPMETNDAFAYFARTATNKQGNNFYDGAPFKPVPARVHRNDRYKLWTPGCLQPTQKHKTPTDKEIMELLYRMQITVTPSVMPEDTRKCLFCHGIGDGVADGPARLLNFDVDKWVHLNCGLWSDGVYETVNGALMNVENALQSGLLATCVHCQSNGATIKCFKTRCSSIYHLNCAVKDNCVFYKNKTVFCKVHAPKNEKDNELTTLSVSRRVYIERDENKQVAAVMHHSDSTDLLRVGSLIFLSVGQLLPHQLQSFHTPNHIYPIGYKIIRFYWSMRNLNKRCKYICTIREVSGKPEFRVMIQEPPEADVEFSDSTPKGAWQKILDNVASIRKENNCLHMFPKFATGEDLFGLTEPAIVRVLESMPGIETLSDYKFKYGRNPLLELPLAINPSGSARTEPRLRSQLHWKKAHTQRTTGGTSSIRPMFGPSLTGSISTPAQGELACPYSKQFVHSKSSQYKKMKQEWRNNVYLARSKIQGLGLYAARDLEKHTMVIEYIGEIIRSELAECREKQYEARNRGIYMFRLDEERVVDATLCGGLARYINHSCNPNCVAETVEVDRDVRIIIFSKRRILRGEELAYDYKFDIEDDQNKISCMCGAPNCRKWMN

SEQ ID NO: 11425 - protein, 1497 aa, Phyllotreta armoraciae
MGDSHQDSQEGRSSRRSRTFKAKASEKFKQFKKGVKNKYEIGEVENVYEVVDEKQYIKEVMSRYDDDWIVGDSSGYIEDGRDIFDDDLDVESVAQASSKGKGIKRKHKNVSENAGKGKLQQMFSTMPTKQKTVAKVDDDEMLSEILGEIDSDTPNTSAVEKPKISQYSTLAINLSAKDYMKNLSQPFKKRAIEKKVQKVPKIQPSASKPIENTNKKVPVKPVTEKIVPVKIQNTEKEEIDSEKNAEKEKIDPDKNAEKEKLDLDTSHFDDDLDETLLEEFNEDLNETVSQVTESEMNVDDFTGDIDTTAIDEIEERINVAGEQLINDIQAEVETEWQYFNNANESFKIATEGSEDPDSSVEITADVPFVKVEGKNVFRFFWWDAYVDPLYQQGTVFLFGKTYCETSKKYESCCVPVKNIERTIFVLPRPFELDENGKPTEKPVTFKTVHDEFNNQVLKRMGITSFKSRLITKKFAFDPSVPVESEYLEVRYPASFPRIFCNDDEDQKDDLSDFDDPSYKTFSKIFGIKTSFLESLFLERKIKGPCWIDISDPEPATNPMSFCKFEVNCLKPTNLKITQFEKPVPPPPLVVATINMRNFINRGSSYHEIVMISCLVQNRYAVNKPPPEPAFQHHFCVFSCPRGQVLPLNLYEALQNYKITKVLKTDNEKAMLNCFINNIVQIDPDLIVGHNLQGYQTAILADRLLKLNCRSYNRLGRLKKRTTNTRQLERTLFLGRLVCDIKVSAKELIKSRSYDLDTLCQVVLKLKENQRVDLEPEDVIKMFKTSQDLIKLISFTMQDSGYIMKMMYNLNIIPLALQITNIAGNVMSKTLMGGRSERNEFLLLHAFHEKGYILPDKVLRKNENESKGSSKKKPTYSGGLVLEPKVGFYDKLILLMDFNSLYPSIIQEYNICFTTLPIMDSDENLVLPDSNLPPGILPTEIRKLVESRRQVKSLMKKPDISKDLKLQYDIRQMALKLTANSMYGCLGFGHSRFYARNLAALITQKGREILVNTKDLIEKMCLDVVYGDTDSLMINTNILEYDQVFKVGVKIKQEVNKLYKQVELDIDGVFKYLLLLKKKKYAAVTLAKSPSGELIATKEYKGLDIVRRDWSQLSSETGKLVLEHLLSDQSSDEKIQNIYDHLAKIKSDLIEGKIPIPLLVITKQLNKSPHMYTDKNSMPHVQVALRYNQKSRDHFRMGDTVPYVICLDGTSNGPMQRAYHLDELKANPDLKIDYDYYLEQQIHPVIARICEPIEGLDAYQLAECLGVNMKRVKIPKLQGGKENIQGENVVKAEVKFKNAEKFTFVCYICKRYNIVSEPLINNIPFLEKCQNADCQSKPIDYLPSIQNQLYRSIRSHITKYYRKLLTCEDPSCPNSPRRLPLKFLKKRPLCSMCCNAVMYKVYTEFHLYNQLAYYRYMFDLSKLKNKPLMDGETELGYRALQDIVDKFMNQSEYSLINLSEVFGQLGWAAPSQKVDSEESKTSILFNEEGNEDAYDDDE

SEQ ID NO: 11426 - protein, 465 aa, Phyllotreta armoraciae
MAAAAAAKIAEVRETTRVERIGAHSHIRGLGLDDSLEARHVSQGMVGQVSARRAVGIVLQMVRDGRIAGRAVLLAGQPGTGKTAIATALAHALGQDTPFTSMAGSEIYSLEMSKTEALTQAIRKSIGVRIKEESEIIEGEVVDLSIERPATGVGTKVGKLILKTTDMETVYDLGGKMIDSILKEKVQSGDVITIDKATGKITRLGRSFARARDYDATGQQTRFVQCPEGELQKRKEVVHTVTLHEIDVINSRTHGFLALFSGDTGEIKSEVREQINGKVAEWREEGKAEIIPGVLFIDEVHMLDIECFSFLNRALENEMSPIVIMATNRGITKIRGTTYKSPHGIPLDLLDRTIIVPTQPYDEKELKEILNIRCEEEDCQMSDNALVVLTRICKETSLRYGMQLIMTSSLIARKRKAHEVDVEDIKRAYQLFFDEGRSVQFLKEYQQEFMFNEIDEKDDMEMETI

SEQ ID NO: 11427 - protein, 389 aa, Phyllotreta armoraciae
MALRTYGDKPISFQLEENGEYYCVGSEVIFIGIFWIYLMIRSNLQVGNYLRLFRGSLYKKYPGMFRRSITNEERRRLIELGLSQHVLASSVSLLRAEEVEDIIEGNDEKYKAVSVHTSEPPMPREGKSKKNMQWVPSLPNSSHLDAVPQATPINRNRVAAKKVRTFPLCFDDTDPQLNIENACQQELLVPIRLDMEIEGQKLRDTFTWNKNESLITPEQFAEVLCDDLDLNPLTFVPAIAQAIRQQLEAFPTEPPSIIEETCDQRVIIKLNIHVGNTSLVDQVEWDMSEKQNNPEEFALKLCAELGLGGEFVTAIAYSIRGQLSWHQRTYAFSEAPLPTVEVPFRNPSESDQWAPFLETLTDAEMEKKIRDQDRNTRRIRRLANTTPGW

SEQ ID NO: 11428 - protein, 186 aa, Phyllotreta armoraciae
MTNNNVKVTVVGDGIVGKTCMLSTYTTGEFPEEYIPTVFEHYGQEITVDGTHYNMTLWDTAGQEDYERLRPLSYPNTNCFLVCFSVDKNLASYDNVWLKWVPEVRHFNPNVPIILVATKTDLRDDPSLACYSTEEGKKLKRKVRAQCYMECSALRYQGLEEIFAEAIRVFLKSKSKKPKARHCRIL

SEQ ID NO: 11429 - protein, 1338 aa, Phyllotreta armoraciae
MNTTTFNPRMDAAQNPVQKMELASRNVENSLLIDNNAPRLIDFMNINPQSGSTASGFADHDYPTLSGLSHIINSMTQIKCVSNVPIPSEIVDHFARVQCHCMMGLFSEINRAWLTVDSDIYVWTYEENTDLAYFDGISETIVCVGLVKPKAGVFHAFIKYLLILATSVDIVVLGVTFTERPGDNADEIQLIPDPVFILPTDGSTVTIINSTDDGRIFYGTKEGNLFEIAYQAESGWFGKRCKKINLSTSTLSFLVPSFINAALSEEDGITQISIDDSRHILYILTEKGSIEICDLGEKGNSFSRISKISQNTLVNQAMNTVKTLDSQNFRPIVSISAIEASESVNLNLVAVSQTGVRFYMTVTSLSNQNPNQRPYTLTLAHVRLPPGYSANITVRPRAVHVSQYRDRNLILISTVNEKDVLWCMSSDLFPFGQGLTEAYTAINLDGPALAISEVRNDSPLQIKDIHEAPPLVVRQHAEPPKKYIVLTSHSIQIFIKLRPVDVLKQILKDSHGQDTEALKAFFTIQKEDQACATALILASLENEDNMDIAEFATRAFFLFGGEPKLAAPINTFSGPSVFCPPVMSTPNMHQYHQQQQQFQTSPQYQHNFPHGISPAANAYELTSPFVFSPKHNGLYLYLGRILRPIWNRRTVDKLCLDGKIVTNHSTVTSEDCIFILNYVTSLHNFLTRNTQLSTLSAAPSHNPQTFNNTTMNMTRLNHTIQDVQLEERASLDALKTFVCHCCQILGLWRILCEHQFHTLIASLPETEQQILQNTTFKDLLLYRHDICTLLIATLVDSYLGDNASVDSISSKLREVCPLFYKTEDAAFSKAVEILKMTRTIQNNDEKEEMIQSALQICKSIGPTINITDICKEFANLKAYKAVTELCAHFGKKIDPDKIAESYYNAEDNSGDQEGYNYYQRRLEIYRHILNMLDQLYNEQNQTQVVSRDPAYSVNQTILLDGVEQSQVGYVMKQVIKDVMETPDEIMHFALYDWLVFKNMTGDLINIQNPSLETYLKRTSTQNPNNIEAMNLLWKYYESCNNHAAAAKILNNLASRTGINVPLKERLSYLARAIMCMRSDKIGYAPYLGVFLRDLEDKMEVAKVQEQILDAIVNLQGQVPNAQEIISALNSGLYEISQLYENFAEPFKLLECQLAIIECAGYTDQVLIESIWQQILTEELRKTYGTGTDKVCQLLNKVKQLSKQYAQSANCFPLSYIVYELEIVNAKLRGDKQLVPCALESMNIPFENLINVYNSLNTISINDHFWQLEENEFHLSEATAALINCFLSHLEQYSSVEKRKITSLCQDAVVALLSNLYSKPNTEVLVNKLRNIQAKLSRI

SEQ ID NO: 11430 - protein, 1379 aa, Phyllotreta armoraciae
MSEFTLSYREVTPEQIDFENWKEITLTTGGTQSTLQDIKVAEKANGYCYKDSAKHCTRNRFIYWRINHNVLELVEHSLDINLTGNRIRYKFDTPILDGVSIHEVLDNIVILVPTVCSVHRLIFPHPNVFHAQDDLLGIYPDLTALSIFSKASIVDTRNPNSFYVFNNPSTANDQLPNLANSYFVPETGEAYFVLAFPSTELLLIRQSPDQVTCAELKGESLVPRFFAGIADKFRHKNSDSENIVSLLFYDLDEETYVLSLTQDAHLKFWSCSKGQCVAVIDVREKITNLKYRVQSAILKKAEDGNNSENILVLFLSFGNKCQFHILKPSVRDQEISLHRLATLESPLNDLIDFAAQIDCLWSVWRSDVGETVVYMASFKSNRWTQVILETEPCDKYFPVKYNDVKTLYLQHIFHPGRFPLHVINKTLSIYKMPTIGSDSHLSISALKQRVCMAVENDIQNLFNKDGTDVNSVEVDEYVECAEWCWQKFDSCCVQYQIASRKPLGLMLLPSVSGAMLLKKSAFSFLRPVDSLEHMTLSTDLYREQFFNFSMLADDLDTVEDVINVFKVIVYIEQQLKDNFMQSFETELLNLQSPDVVIEDLLKKIYVEMDSDFFSHILHLIKDVNDLYKAIHKILELLRYENTLANPDNDINPAAMYYFNSLLGTSLVAQSFRQQAEIRFQICRNLLLLCNFLVMDRTLNGGVLEGVRSVCMPDIVVLTQASFVVLWLSGLTMFESDSIRDSSMSTLNPLKLTPVYNLLPFTRCTSLLEVFISSSGVQDARKSFARVSCKDEALARWHWSLLPYVNHIRHLIWPISGCTVFEEWLLSSGQHVWLQQYVRLLSNWCEWNVCTRNFLLASSFLTSGEFYKAEELFETASKGVFTDTFLKNRIKSVDENNIRTTIHYYLKVIQLFELCNARSHVINVANTALCVVKRDDPLAATLFSIKFKHHLALKHYQLAFDSLNSNPDGERRKDNLRDLVKTLLDEKKLNVLLNFTYGSMDEFFANIVLTRARAADVMNNVFYDFLYSYQIKKGPPSFRLAASAMYEQAFRLSQKTTIEALEKQVKCYLAAKNVLHLCPTQHAWVVRPADPDEEDEQVIFQPLAGSNGEIRTFKIKKQIEVVDIETIGKELTFASAKLKLLQFNPSVSINICDPLELVISLNNSGMFKVAFEICSTFDLPYSLVFEALTKRCVLLTEAEDPNAWNWLVENDLQDLPVNRESAADVVWKFLQDCLEKYEEPNMSCLHNVVCRKIINMQIYLPHWLKASYKARNPSELLRLLHASGRLEEAVELAKDYILSAMGYGNEDFGFAQPLAPTSPAFCLPVYAIQRLVDELDMQNSMNIEKPFVHEHDDLKVLFSKYLETAIRVSNQMCQVKSKAI

SEQ ID NO: 11431 - protein, 968 aa, Phyllotreta armoraciae
MEVSDKNLETLSRYLQETLNPDPNVRRPAEKFLEGVEVNQNYPLLLLNLVHKPEVDMTIRVAGSVAFKNYIKRNWVVEEDQTDRIHESDRLAIKNLIVTLMLSSPESIQKQLSDAISIIGKTDFPLKWPELITEMVEKFSTGDFNVINGVLRTAHSLFKKYRYEFKSNELWTEIKYVLEKLAKPLTDLLVATINLSQTHANDVAALKIIYSSLVLICKVFYSLNFQDLPEFFEDNIQVWMTNFHTLLSVDVKALQSQEDSEAGVLEQLKSQVCDNVALYAQKYDEEFQPYLPQFVTDVWSLLVATNLQPKYDLLVSNALQFLSSVAERSQYRNLFEDDNVLSSICEKVIIPNMEFRTSDEELFEDNPEEYTRRDIEGSDIDTRRRAACDLVNTLSQNFEQRIIEIFGRYLQVMLAKYAENPKQYWRSKDAALYLVTSLVSRGSTQKHGVTQTSQLVDITQFCRQHILPELERPDVNDLPVLKADAIKYVMTFRSVLPSDIVVSTLPQLIRHMPSESCVVHTYAACTLEKILMLKFNNQPIVTGAQLEPLASELLTNLFAVLQKPVSEENEYIMKALMRTFATLQDRIIPYLNVALPKMTEKLQMVAKNPSKPLFNHYLFEAFSLAIKIVCKVNPTAVTSFEDILFPIFQGILQQDIQEFIPYVFQILSLLMENTPQGSLSDPYMQLLPCLLAPILWERPANISPLVRLLAAFATQAAPQIVLQDKVGGFLGVFQKLLASKSNDHEGFRLMQSLIQNLPIEALTPYHKQIFFLLFQRLSSSKTTKYVINLIVFFCLYVVKYSANDLVTLIDEIQAQMFGMVLEKLLIAELQKIAGDVERKIVACGVTKLLCDCPQMYTGSYQKYWPQLLQALLAFFEMPRDETTFPDDHFIEVDDTPAYQATSAKLNFADGTKNDPLQGVSEPRQFLVQSLATLGASQPGRLPTYINNMNAQSQTILQGYLAKFGVQLV

SEQ ID NO: 11432 - protein, 199 aa, Phyllotreta armoraciae
MAKVQLCNITVMDNPSPFLNPFQFEITFECIEELKEDLEWKMIYVGSAETEEHDQILDSVFVGPIPEGKHMFVFQADPPNVSRIPENDAIGVTVVLLTCSYKSQEFIRVGYFINNEYSDPEMRENLPSPPQFDKVIRNILASEPRVTRFKINWEESSGTQENGTTIAEAPANQTTETSASVEVPAFNENSNSWATMECS

SEQ ID NO: 11433 - protein, 312 aa, Phyllotreta armoraciae
MDQMLPSPGFSIPSIGTPLHQPEEDQLILPNAIQQQQSLPTTNSQVPPLAPMGGSTPTLGLGLGHAMSMPHTKYVTGFSLPISSMTPQTPQHTMMSPMVNVGGTGTTSSGVTPTLGPSTPSPMTPMTPHSADPGIVPQLQNIVSTVNLSCKLDLKKIALHARNAEYNPKRFAAVIMRIREPRTTALIFSSGKMVCTGAKSEEDSRLAARKYARIIQKLGFPAKFLDFKIQNMVGSCDVKFPIRLEGLVLTHSSFSSYEPELFPGLIYRMVKPRIVLLIFVSGKVVLTGAKVRQEIYEAFDNIYPILKSFKKQ

SEQ ID NO: 11434 - protein, 188 aa, Phyllotreta armoraciae
MVLLSVLGLLKIFKESFIFYLPKSLFKAHKMAAIRSMSRLLFSRSLQTTVKRGYADQMSFTFAAGNQVFYDAKSIKQVDVPSFSGSFGILPAHVPTLAVLKPGVVTVYEDGGAVKKIFVSSGTVTVNDDSSVQILAEEAHPVENLDVSAARDLLNKAQSQLSSATTDQARAEAAIAIEVGEALVKAAE

SEQ ID NO: 11435 - protein, 321 aa, Phyllotreta armoraciae
MSGDGSQNEHFDTLFLSIAQHHPQGPTQLLDTFVNFLSRKTDFFTGGKEGEWEKLVLNTFKKYEKSSREQHAAELKEKLEQEARRKAKKEAESAKQAQITELTDEQAEKLQAELNAKKSPSSAAPSNSSNTPSTSKIEEDEDESEKGKLLPNKGNGCDLEKYNWTQTLSDIELRVPLECDFRVKQKDLTVNITKKHLTCGLKGRPPIIDDDFQHEIKLEESNWVIEDGKSLLFAIEKVNKMNWWSKIVKSDPEISTKKINPEPSKLSDLDGETRGMVEKMMYDQRQKEMGLPTSDERKKQDVLKKFMEQHPEMDFSKCKFN

SEQ ID NO: 11436 - protein, 158 aa, Phyllotreta armoraciae
MQSPSGMVHGYPQASILQWSPDKKYSDRERWICVYPAYINCKKTIAQGRKLNKEKCVENPTHQEIRDVLVAAGLKVGVENKLYSRERSKELLYRGRIRVQLKNDDGTLCNPNFATRDSIMLHLGDMIPKLKSRQNKGSGDPQPQTTSSKGKGKGKGRR

SEQ ID NO: 11437 - protein, 731 aa, Phyllotreta armoraciae
MEEPEPTKRQKMPKVAKVKNKAPAEIQITAEQLLREAKERDLEILPPPPKQKISDPAELADYQLRRRKQFEDNIRKNRAVISNWIKYAQWEESQKEIQRSRSIWERALDVDHRNITIWLKYTEMEMRNRQVNHARNLWDRATVLLPRVNQFWYKYTYMEEMLENVAGARAVFERWMDWQPDEQAWQTYINFELRYKEIDRARQIYERFVITHPEVKHWIKYARFEENHGFIHSARQIYERAVQFYGDDHLDEKLYIAFAKFEENQKEHDRARVIYKYALEHIPKDETKELYKAYTIHEKKYGDRSGIEEVIMSKRKLQYEQEILQNPTNYDAWFDYLRLVEGEADLETTRETYERAIANIPPSKNKQYWRRYIYLWINYALFEELDAKDYERTRQVYKACLEILPHKTFTFSKIWLLYAQFEVRQKNLKAARKILGMSIGMCPRDKLFRGYIELEIQLREFDRCRKLYEKFLEFGPENCVTWMKFAELETLLGDTDRARGIYELAINQTRLDMPELLWKAYIDFEISQEEPNNARQIYERLLERTSHVKVWLSYAKFELNNPSEEDFNVRLARRIFERANENLKNFPEKEARVLLLENWKEFENNHGDDEHKEKVNAKMPRRIKKRQKVIDEDGVEQGWEEVFDYIFPEDEASRPNLKLLAAAKNWKKNTDEPDEDSESRTTLSSSSQRMKEKLLASVKNWKNNDKENSDSNKDDCSNEEEVQIDNNEVED

SEQ ID NO: 11438 - protein, 476 aa, Phyllotreta armoraciae
MGIKFLEVIKPFCSILPEIAKPERKIQFREKVLWTAITLFIFLVCCQIPLFGIMSSDSADPFYWIRVILASNRGTLMELGISPIVTSGLIMQLLAGAKIIEVGDTPKDRALFNGAQKLFGMVITVGQAIVYVMTGMYGDPAEIGAGVCLLIIIQLFVAGLIVLLLDELLQKGYGLGSGISLFIATNICETIIWKAFSPATVNTGRGTEFEGAVIALFHLLTTRQDKIRGLREAFYRQNLPNLMNLLATVLVFAIVIYFQGFRVDLPIKSARYRGQHSSYPIKLFYTSNIPIILQSALVSNLYVISQMLAVKFQGNFFINLLGVWADVGGGGPARSYPIGGLCYYLSPPESVSHILEDPVHAVMYIIFMLGSCAFFSKTWIEVSGSSAKDVAKQLKEQQMVMRGHRDHSMIHELNRYIPTAAAFGGLCIGALSVLADFMGAIGSGTGILLAVTIIYQYFEIFVKEQSEMGGMGALLF

SEQ ID NO: 11439 - protein, 162 aa, Phyllotreta armoraciae
MSMVSSSAVELSSYRDQHFKGSRAEQDKLLRLSTTLYVGNLSFYTTEEQIYELFSKCGDIRRIVMGLDKYKKTPCGFCFIEYYTRNDAENCLRYINGTRLDDRIVRTDWDAGFIEGRQYGRGKTGGQVRDEYRTDFDSGRGGYGKITQQRIGPMDTPSYFRK

SEQ ID NO: 11440 - protein, 306 aa, Phyllotreta armoraciae
MAATVGRICGVGLLKPNNLTTIGQIGSYSTAKEWTRGKKALLGTLGMLAGGTGAVLIALDQSVKASELELHPPKNIWSHSGIFSSLDHASVRRGFEVYKQVCAACHSLRFVAYRNLVGVSHTELEAKAEAEEQMIQDGPNDVGEMFMRPGKLSDYIPSPYPNEEAARAANNGAYPPDLSYITAARHGAEDYIFALLTGYCEAPAGVVLREGQYYNPYFPGGAISMAQALYNETIEYGDGTPATASQLAKDVSTFLKWTAEPEHDDRKRMLIKVIGIFSFLLGVTWYIKKVKFASLKSRKIEFRPKN

SEQ ID NO: 11441 - protein, 564 aa, Phyllotreta armoraciae
MLALQQYSGSSDEEEDKQKSPGNNEPSTPSEYSLKGQLAICAAPEVLPTGLEEDQMHIDVDTKELAFNPKFDVLFAPALGPANPFKTQQQLVERNMLSGHIERAHVSEFQFENQRRTFASYGYALDPSVTNDGQIKVVGSSEAEESSIKTVFEASKTRPLDKRKRKKNDDPSDVDGFLGPWGGFVDEQKISKPTEEEQIELDEISSKKNKKGKPNEDKPLEEKSVLHIKDAVDYQGRSFLHAPQDVGVNLRSDTPPDKCFLPKAHIHTWTGHSKGIAAIRLFPRTAHLLLSAGMDCRIKIWEVYNERRCIRTYYGHRQAVRDINFNNSGKHFLSAGYDRYIKLWDTETGQVLSRFTSRKIPYCVKFNPDKNKQHLFVAGTSDKKIICWDTRSGDIVQEYDRHLGAVNSITFVDENRRFVTTSDDKSLRVWEWDIPVDMKYIADPTMHSMPSVTPAPNGKWLACQSMDNKVVIFSSMNRFKINRKKTFSGHMVAGYACSLDFSPDMSYLTSGDADGKVYIWDWKSTKLFKKWKAHDNVCISVLWHPHEPSKLISAGWDGLIKYWD

SEQ ID NO: 11442 - protein, 268 aa, Phyllotreta armoraciae
MVQKKPKKKVGKKVAAAPLAVKKVEPKKEVNPLFEKRPRNFGIGQDIQPPRDLSRFVKWPKYIRIQRQKAVLQKRLKVPPPINQFSQTIDKQTATQLFKVLEKYRPETALQKKNRLKAKAEAKVAKKEEAPTKRPNTLRAGTNTVTKLVEQKKAQLVVIAHDVDPIELVLFLPALCRKMGVPYCIVKGKARLGLLVRRKTCATVALTQVDSGDRSNFNKLLEVIKTNFNDRADEIRRHWGGGILGSKSAARIAKLERAKAKELAQKQG

SEQ ID NO: 11443 - protein, 354 aa, Phyllotreta armoraciae
MATIIKDITLQENIPQNILFEKHIDFIKEYGQKENNFEYAMTDYLRISGMYWGLTALELMNASPPHTIEEISDYIKHCQDPESGGISSCLNHDPHILHTLSAVQILCMYDNLKAIDVEGVVKYVKNLQLPDGSFTGDKWGEVDTRFSFCAVATLSLLNRMDAIDVNKAVDFVASCKNFDGGFGSRPLSESHAGLIYCCLGFLSVTNRLDIVDRDMLAWWLCERQLPSGGLNGRPEKLPDVCYSWWVLSSLTILGKLHCIDANALKKFILACQDTESGGFADRPGDIPDPFHTVFGISALSLLGNDTVQKVNPTYCMPQHVIDRLQLKPGARNERGPHYEFHDDRRATKEVTLAG

SEQ ID NO: 11444 - protein, 889 aa, Phyllotreta armoraciae
MHQETLQLIQILEKTVSPDKNELEQASSFLEQASQTNLLGFIKTLSDILRHGGNSPVARMAAGLQLKNQLTSKDSTIKATYQQRWLLFSEEVRDYIKKNVVGALGTETNRPSSAAQCVAYIAVTELPQGQWPDLISTLVSNICHGNSTEMQKEATLEAIGYICQEIESDVLVSQSNDILTAIVHGMRSSEPSNHVRLAATQALLNSLEFTKANFDLTTERNYIMEVVCEATQSPVSQIKVAALQCLVKIMSLYYQHMEPYMAPALFPITLEAMKSENDAVALQGIEFWSNVSDEEVDLAIEDTEAAEAGRPPTRVSRHYAKGALQYIIPIILQKLTKQEELDDEDDWNPSKAAGVCLMLLATCCEDEIVPHVLPFIKENIKSDNWRFRDASLMAFGSILGGLEPNTLRPLVEQAMPTLIELMYDNSVIVRDTAAWTFGRICEIIPEAAINENYLKPLLESLITDLKAEPRVAANVCWAFSGLAEAAYEAAAVNEETGTPDTYILSPYYEFIIQRLLETTDRADGAQANLRPAAYEALMEMVKNSPKDCYVTVQKTTMVILERLQQVLQMETHITSHNDRSQFNDLQSLLCATLQSVLRKVTPEDAPHISDAIMTAMLTMFNSNSCKSGGVQEDALMAVSTLVEVLGENFIKYMDAFKPFLYIGLKNHQEYQVCGTAVGLTGDIFRALKLKALPYCDEIMTLLLENLRDQSVHRSVKPQILSVFGDIGLSIGSEFKKYLDVVLSTLAQASQAQVDRNDFDMLDYLNELREGVLDAYTGIIQGLKGDGLTPNPDVMVLEPHIPFIVQFIIVVAQDTEHSDGTVAVAAGIVGDLCTAFGSPMVQLLDLASINDMLAQGRRSRVSRTKTLATWASKELRKLKMPAPAAAAASW

SEQ ID NO: 11445 - protein, 500 aa, Phyllotreta armoraciae
METILEQQRRYHEEKERLIDAMVKEMLHKKNTYREAINSDHRQKYLLDRYMTSTERLIDLYEDKDGQRKAEVAALTGPNEFNEFYSRLKQIKDFYRRHPNEISVPMSVEFDEFAKARENPNEDMANFVEFTDEEGYGKYLDLHECYEKYINLKGIEKVDYITYLAMFDQLYDIPKERKTGEYRKYLLYLIEYLTWFVQRIRPLMDLDSDLQEQVDQAMGNWDNGTVPGWPKETGSALANVGAHLDLSAFSSWEELASLGLDRLKSALMALGLKCGGTLEERAQRLFSTKGKGSLDPSLMTKNSKNRVTKEKEALRQRELATLEAQIYRLADLVSAQRAATKENVQRKQARTDGERDDSENEESEEESPDEADDDVPYNPKNLPLGWDGKPIPYWLYKLHGLNISYNCEICGNYVYKGPKAFQRHFAEWRHAHGMRCLGIPNTAHFANVTQIEDALALWEKLKVQKQSERWQPETEEEYEDSQGNVVNRKTYEDLKRQGLL

SEQ ID NO: 11446 - protein, 212 aa, Phyllotreta armoraciae
MTIGKNNKMIQHINYRVRITLQDSRTFIGTFKAFDKHMNMILGDCEEFRKIKPKNSKVEREEKRVLGFVLLRGESIVSLTVEGPPPPEEGLPRVPIPGAAQGPGIGRAAGRGMPPGMAGVPVGLQGPVRGVGGPSQQVMTPTGRGQVSAPPQMNQAPPRMGGPPPGMMGPPPGMMGMPPQMGMGRGGPPPMGMRGPPPGMMRGGPPGPPRPY

SEQ ID NO: 11447 - protein, 128 aa, Phyllotreta armoraciae
FPHCIGAIDGKHIRLIRPANSDSMFFNYKQYFSMVLFAMVDSNYLFTFVDIGSYRKSSDSGIFKNFALYEKMLNGTLNIPTATPIEGDLVEYPFVIVGDEAFPLSENLLRPYGGTNLSFEKRIFNYRL

SEQ ID NO: 11448 - protein, 5236 aa, Phyllotreta armoraciae
MEELTSGLDPDDLMDLDEPEGSDLEEDDEDLIDDHVSSPFISSSAPESTANSVASSPIHEDFPPPFNFTGKPLHVKRGRGRPRREGGKPSAPRTTRGGGTGVSRVRRPRPPGFSRRGSLGGSRSVRQVDRSDYEMSLFAGSPVDDGLLDPETGSMIFPEKFVPAIEEPPYFPEHWPGKVCALCNLGERSQLGQGEMLRLNCPEGFSPEKVISEQILERALQAPDKECGDKSPKGPVTCRRQKSFNKCRHPSITSEYVDELTIIGYNEVPDVSSLFEPNGQFYVHRNCALWSNGVTKAENSALLNVGPVVSQCSSKKCSFCNHYGASLTCHVDKCTKIYHFPCATAAGAFQDVSSLTTLCNDHLGQVAVLTNASPCLTCASMGDIANLMFCSGCGAHYHGICVGLAQLPGVRSGWQCRKCRCCQVCRVVGDESKLMTCEQCDKIYHASCQRPIVTSIPKYGWKCRCCRVCGDCGARTPGAGLSSRWHAHYTVCDSCYQQRNKGFSCPVCHKAYRAHAHREMVQCSSCKKFVHGTCDPEADVVTYSQKKEISVDYEYVCLHCKNSTARQITAKRASIDDPSDVSASHDSLYDDTSELDLPSPDEFARNMGLGKGKPYSANKIAKKRLSFTVNPVGRPKGTGKVPPGKMGFMKRYRLTEFNRKRGPKAKMRGIFGVPGVGLQRPISDGKTDEEPGVENRLVLCSAKDKFTLTQDICVMCGAFGTDQEGCLISCVQCGQCYHPYCINVKVTKVILQKGWRCLDCTVCEGCGQRNDEGRLILCDDCDVSFHIYCMDPPLDYVPHGNWKCKWCAICQSCGATDPGFNCTWMNSSTQCGPCASHVNCPSCNEPYGEGDLIIQCVQCERWLHGACDFIKCEEDAEKCAEEGYNCILCRPRDVPPPHMVPAAVTPKPPTPTKSPELGKSTSYYMDGVCLSEFGSNLIKSLALEYHGSRKKRKKIPTVQDKEAGIMATIESVVAGGNIIPTNMEDSAKLELVDIKDEPQELYKEGMMWTKEDGPPPEGFTIITMENGLNVLRRKRQRNLQKLGIGGFVVRMRGIRTGQDNDDVDSTIGQSGLNANDIVPSPADVDKPRRKAIRRKPKSKLAETFPAYLQEAFFGKDLMDTVDCKKEEVDCYSSDEEKTDKHYKSINLSQDEIIAIVASGKTEKLENNNKDSTKEVKPTVLKEEEEDNPEDLKDVLALPGDLLDTDLVNSIMEDEEELSKTTASLVALDSNLPHDTELTDTLSSSGNSKETKDELSDILGPHFNLDSISNINSKDVEDIFKGVLTDESQESQESSNFSLQGNSMFSNNNAQQTVAQHPIINQPVRPKTLPTVNHNLNSPVSFPPPSPYHSEYSNSPQFSPAFTESSCSWVSGNETPEIDSTNVTVTSTYNQRSSDKMKADESLGKSATISAVLYANINHPEWKKEYPNWPDRYKQIIKKWRTLSQEQKAPFLQHARDNRSQLRMKKAQQSQTVKETASAATSPNASKPLHQAGQALVTTLQAVTQQPAGVPAAPAAPVSEVCTQTRPTLTPASVSSVSVPTPSPKPPSPTTHQQFTVHGSFAGPGDRVGPAPNVTVNPHYQPNGESAAPHHPRLIAQSSASDQQIRVLTPSEIMRTLPSLYQENYEPQGSDQEKIALQQKSAREAEQERQWKQLQALRQQQTQQTQNILHEQRVQAIARVQRQISTDPAQQFINEQQSPLQVNTPQELSPSTTPAPSPRQFLGIKSPTFPVPSPIQQTSVRANTPSQSPHDVSQPSTPDGNDHFIHSPTNPKPNFQPRLPNDPFAAQPATPRPQFGMARPPLQNFGGTVRNEQQDININRQLRELLQRQQVKKLDELLPGKAPPQRLWHANDQQEGSDASMTSPVAQGAQSAQGADATFRQPLPPGVVKPRLAISSVNRPILNAVRVNQLDPRIQNLDPRMRLILQHQQQRLATGIQQQFIRFTSNVRPTTVEQYEQLLQRQGNNQNQIHAEEQQQGVARIPITQASVIQRPHVAQAVVTGAAAATNSSTESNPSEEGIPDNVTAELEKLEQETGTMVELQGVSDILGGLDDDDELLAEMGADFNILEYADPELEALTGGKTNILDLELEEEPVKKEKLASNANTSAPSQKPTPNVATTATSNSTAVTTPTEANTEPKIDNTIQQNIPKTVQAAPQQLQHPASLPQQQNMPQHGAQVQVQSQQSQPHPPQQMPIQSTLHIQQIHQQMVHQVQQAAAQGRPMPPGSKMQTTDGFVGVVMANNAVQLQIPPNYQQRLLLLQQLQNQKLMRVGSTQPRAALQVAPNQIPVGMNPGPRMPVSAPPPPPPPYPGPPPPYPGNANQHQQEQPLLLEDLLEQEKREQEKLQNQPPNHEVTSSTGNETESALMSDQDFERLKADVFNSAPVNNISSTNQGNAGQTSQAWPQLQNRQAVVPAAASQHTMEVTTRVQMFNPNLVPAPPLPPENIATEQDKQAQLLYEQWLNHQNNTLVQQLRYYETEVQKLRKSKKSLNSKQRQLRKAGNQLTEVDATELQRITAEQAILQKHLESSRKQNRQHGMLIQEYRNKHPAIKQRTGTDQIQSPLGHPASSPIQQSSASLSPMLSPSVSPMTQNSSPLNSPGPMVPSSPGHGPVQNILQSPNGANAAQMSPMQSSPRIGTPHSQSDESPGSAQSPSQVCLPPPMPRMTSPQHRRVVTSPVGMSQMRFINNNMLQQRVRMQSPIQNFQQKPGTPSPLNSPTSQQMSVNQQHQIQKQLQQQQQQQTLLQQNLEGDPNAIHSQRTTQLLQHRNFIRQQVSQQQISPQTLTPQQHQLMLQQQKQLAQQQQQQIAQMNAARLQQQQQQQQQQQNNPPHSPMPPKSPMINQQIMSPHSMPQSPMQMPPKSPMVPFNPNQNPNSPAARSPAFHQGINQPTSPITHGHQPPSSPMPRSPMINQTHSPHNVRRPPSANSSPAMPDRPHSVENSSPRMYSIDQLVQESLANQNVNAQYNYASDMINESGGGNSNNPIPCPPEIPRFRYFKLGLRGGAPMWSFGRGAKRIPAPPNAKPDEPKAKKESHLSKVSILKRKTSIGSIGKVGSLVSSDYNDLDDSSTTPPVTPPLASTSRGMVSKKKNLELQAQKESVIVMHSPDDNKQLEIMDYDDDNNTVLSSEVSLSSAARNDDDLVEIETISQDLAEGLSSPLESDQIGDEFLLFPGNMVVDMSGEGHYSEKEEEETEEFTDQNMHIVIRSPTTSDDEFIMPCKVKQYNEDEQEDNPESPDQEEFGESSDMLTGYDNEETDIILSDQTTSVPEDSISTKEDFEELIDEGSRKNNISKQEVTAKHIQDFHRYTELFDYGKPDTQTAKKPVTKKFQPKVSVVRGVALPSKPNTEKIIITQNSNVLNTSQASKVTSIILTHNANVRRNIISVPKIVSTVSPAITIVSASTSQMASILPSKFTVPVISASAVRQLSNVKVIDKPSSSSLSISTRDNVLPKKIFEDDSVSPDSSNCEDEKSKDSFDDKVKSESPPQEIKQPAFVKSDANPQVISLKSKNYSDQSKKIEHLQIVNISSKDVVQRQRIPSPMISKASPVIIHNTPELKMTAQVIQESQTRMKITTTTDTEHYDESTDDTKSVVISIPSPTPSQEQMLDSIAFQALENRRREYDSIEDVLDMIENIENITAEPPEILEENTLQSSDSNSNIENKNTETKELQLPTSESEPSVTKSSIVPQLSPLSQPTELTTNMANASQQLRTLLSSLQTTSTSSPTSVESIAKSIGQKIITSSSANQPIVASRVISQQAGRQSPVVTSVSTVIVPNFKQKITVTATSTSRSSPVKVVTTSQQLAGSIITSTLNYLPNRTIGIQMVPEQSKLPPASIVTTMQQINSITSSQESKKPSLTLTAMLQNQPAANMMTKSSADTITAASLLGSPISLPKTGFTTSLVQAQPSVVLSNIPPAPSQPSAVTKTTADSITAASLLGNIAKSSFSMQPSSTVGVATSCPNKTPTSTTNLLHTQLTKVVRSKSVDDVKELAKIDENKPNVSNENVDDSSNSGCKLSQLTTAVCNKTEDSQNVLLKKLLQNTACASTQSSPPASTSIVTTSAANAISKVANSSSNASVEQPPVSAPSIVPIQRSASRDELLSPPQDVQTMIVIKKEPPLVPLSQPSPVMNSNLNAHTPEVKKEFIDESSQHSEVSDHSRSDAPIKEELETMENAAEKMLLDKEELKKQKRRMYQQKRRQNQILNKELAQQQPKKRPRKNSKIDEDYDTYIDGVLAQLRQLPPIQVSEPVLNRNFGVVPLFGCGDLSKIGAKDYSTHLGELTGSYGYGELPGFTDFYSTKPYGDMDPLPEKPPSSTQRGFYDQEFPLIRFDADEHKKFDVFCREDSPDSILSSSSPECTREPETKFVGLKLISDSEEDEEDDAKEAVAKGRMSPVVPVIKPVPIRLKPAGELYFKESLNENKENINSDSLHVMTKSKFDNKQSPPANVSGHVTVTLTLTSSAAEDIMGVLRDLANILHIPAPTSYQIVERTASPPSQKLGLYRTKGKDGKEGAPIDIQSILNGATKFCKHCDVIILSNIIRRKVSDLPFLAKDSDLLSDGEELFFCSSACYMQFALMHRSPSISEDKAAEIINHLSQKDNLDSKQKLSSADSLDSNKSIAQKLSFNIKDSKREFEPMETNDAFAYFARTATNKQGNNFYDGAPFKPVPARVHRNDRYKLWTPGCLQPTQKHKTPTDKEIMELLYRMQITVTPSVMPEDTRKCLFCHGIGDGVADGPARLLNFDVDKWVHLNCGLWSDGVYETVNGALMNVENALQSGLLATCVHCQSNGATIKCFKTRCSSIYHLNCAVKDNCVFYKNKTVFCKVHAPKNEKDNELTTLSVSRRVYIERDENKQVAAVMHHSDSTDLLRVGSLIFLSVGQLLPHQLQSFHTPNHIYPIGYKIIRFYWSMRNLNKRCKYICTIREVSGKPEFRVMIQEPPEADVEFSDSTPKGAWQKILDNVASIRKENNCLHMFPKFATGEDLFGLTEPAIVRVLESMPGIETLSDYKFKYGRNPLLELPLAINPSGSARTEPRLRSQLHWKKAHTQRTTGGTSSIRPMFGPSLTGSISTPAQGELACPYSKQFVHSKSSQYKKMKQEWRNNVYLARSKIQGLGLYAARDLEKHTMVIEYIGEIIRSELAECREKQYEARNRGIYMFRLDEERVVDATLCGGLARYINHSCNPNCVAETVEVDRDVRIIIFSKRRILRGEELAYDYKFDIEDDQNKISCMCGAPNCRKWMN

SEQ ID NO: 11449 - protein, 687 aa, Phyllotreta nemorum
MPREASLERHKHKSHKIKKSRSSSRSERSQEKRKHSSSSKKKSSFHEDADRKKKKKRSKSSSSSSSESESTSSESSGKSVELLKKLEKERLRLAEEKKKEKELLKATETAEEKRLRRLMKKEAKERRRKEKMGWDNEYLHYTNSDNPFGDGNLLTTFVWNKKLSKEGIKNVGHEEIEAINRLKQEENKRELEKVKKRRLERELERQRREEETQMMQRTKEAAQFEEWERQEDQFHLEQARLRSHIRIQDGRAKPIDLLAKYISAEEEVDAVEMHEPYTYLNGLQIKDLEDLVEDIKVYKELERGKNLDYWNDITVIVEDELQKLRKIEKQNDFDLGLNRREGIHQSVATDVTSVFKGKTAAQLAALEKQIGSKISSKADGIDIGYWESLLSQLKAHMARARLRDRHQDSLRRKLQVLKAEQAITGVGKTHSETHSTDNEETTMEPKPGTSQDSLETMEESNEKSEDAAHAWLSECFSAYQAGGYSPKFLTPDDTEPGTIVVSEEDDVKRLEFARMQVMGQGTNIENVITKEELLLQKEAKKGMDGDEAQFSVEQALDNPVYLWSDKYRPRKPRYFNRVHTGFEWNKYNQTHYDMDNPPPKIVQGYKFNIFYPDLIDKNSTPEYYLTPSPENREFAILRFHAGPPYEDIAFKIVNREWEYSYKRGFRCQFHNNIFQLWFHFKRYRYRR

SEQ ID NO: 11450 - protein, 437 aa, Phyllotreta nemorum
MDNLEANIMDKSMRSVFVGNIPYEATEEKLKDIFGEVGQVLSFKLVFDRETGKPKGYGFCEYRDQETALSAMRNLNGYEIGGRNLRVDNACTEKSRMEMQNLLNQPPIENPYGEPIQAEKAPEAISKAVASLPPEQMFELMKQMKTTIQNNPTEARQMLLQNPQLAYALLQAQVVMKIIDPHTAASLLHPVNQVPATLLPGDKNVTVQVPIGNQYREPPAPVQAPRQEYQPVPPPAVHPNHVQQPVFTGQDVDLRSMGNVTDPRIRPMMVDQDMRQMPNVIQNPLPPTISESLAKAGDSKSDNYSRDPRSVSGGFPSDPRQARMDPRQKSLAPTSQQVPSSVNPKIMPNQAGPAAIRPVQNVIAQSASVAPAASAAAASANVMSPGIGGAGATDQEKAALIMQVLQLSDEQIAMLPPEQRNSILVLKEQIAKSAHVR

SEQ ID NO: 11451 - protein, 392 aa, Phyllotreta nemorum
MAQMDAEREKSRQEYRKKVLEHKEVESRLKEMREQLKDLTKQYDKSENDLKALQSMGQIVGEVLKQLTEEKFIVKATNGPRYVVGCRRQLDKAKLKAGTRVALDMTTLTIMRYLPREVDPLVYNMSHEDPGDVTYSAIGGLSEQIRELREVIELPLMNPELFMRVGITPPKGCLLYGPPGTGKTLLARAVASQLDANFLKVVSSAIVDKYIGESARLIREMFNYAKDHQPCIIFMDEIDAIGGRRFSEGTSADREIQRTLMELLNQMDGFDSLGQVKMIMATNRPDTLDPALLRPGRLDRKIEIPLPNEQARLEILKIHALPIAKHGEIDYEAIVKLSDTFNGADLRNVCTEAGLFAIRAEREYVIQEDFMKAVRKVADNKKLESKLDYKPV

SEQ ID NO: 11452 - protein, 259 aa, Phyllotreta nemorum
MARRYDTRTTIFSPEGRLYQVEYAMEAISHAGTCLGILANDGILLAAERRNTNKLLDEVFISEKIYKLNDDMVCSVAGITSDANVLTNELRLIGQRYLYQYGESIPCEQLVSWLCDVKQAYTQYGGKRPFGVSILYMGWDKHYGYQLYQSDPSGNYSGWKATCIGNNSSAAISSLKQEYKEGDMMLKDAKSLAVKVLAKTLDMAKLTSEKVEMATLTRRNDKTIINILNSKEVEELISDYEKSEAAAEAIKKQEQKSAA

SEQ ID NO: 11453 - protein, 886 aa, Phyllotreta nemorum
MSESKAEPIKVESKANDDKNKNDLSDEDKQLQEELNLCVEKLQENDSKLYMPALQALGNHIRASTTSMTSVPKPLKFMKPHYDTMKQIFEKITEPPVKCLCADIISVLAMTMGEGRDCLKYRLLSDLDKIGEWGHEYVRHLAGEIAGEWAETDFLVNTEIRDKLILLTKQIVPYNMAHNAEAEACDLLMEIERLDLLDKYVDENIYPRVCLYLTSCVPYVADPENTTLLQTALMLFRKFKQYPQALRLAMQLNDHSLIEEIFLNCPDTDVQKQLAFMLGRQQIYIEVPDSTPEYEDLIEIMANCHLNNHFLNLARELDIMDPKTPEDVYKSHLENSRPPFGGSQVDSARQNLAASFVNGFVNAAFGQDKLLMEDGNKWLYKNKEHGMLSATASLGLILLWDVDGGLTPIDKYLYSSEDHIKSGALLACGIVNCGVRNECDPALALLSDYVLHNTNIMRIGAIVGLGLAYVGSNREAVLSLLTPVFSDPKSNMEVIGMSALACGMIAVGSGNLQVTTTIMQTLMEKSETELKDTYARFLPLGLGLCMLGKQEGVDSIIAALEVIPEPFKSMATTMVDICAYAGTGNVLKVQHLLHICSEHYDGDSSDKSSKDKDKKDASEKEKDLSSRQAVAVLGIALISMGEDIGSEMAYRTFGHLLRYCEPVIRRAVPLALGLISVSNPKLSILDTLSKFSHDSDAEVAHNAIFAMGLVGAGTNNARLAAMLRQLAQYHAKDPNNLFMVRIAQGLTHLGKGTLTLSPYHSDRQLMSPVAVAGLMATLVGFLDVKNIILGRSHYLLYTLAAAMQPRMLVTFDEDLNPLPVPVRVGLAVDVVGQAGKPKTITGFQTHTTPVLLAYGERAELATEEYLALTPIMEGFVILRKNPDFNA

SEQ ID NO: 11454 - protein, 504 aa, Phyllotreta nemorum
MTDSNMESKEEKQASPENVKLKPEATEPEAPPAQTTATGVIRRNFITPAGTIVETNEEQPPEPTTEEVVKTTSSNPSPAEQKTEPAEIVTYAAEVLPQEQREQFADAKSYAVEMPAENFQNPSFTQDISYVNIEGTVVPVTISEIEHPGDYANLQTAQYNNGYTDGSQYLTNHQYQNMYIDRTTVDNSTSATVLYRDDPNLGASRFQGNYDISSSQSQVNLLPASGEAYYPSTSNWTPTSSGSYQQQYPSGNINVLQADSTQAFAGPYINATWSSNSMEDGRQSSQEVLVKECVNCGASVTPLWRRDGTGHYLCNACGLYHKINGVHRPPTKPTKKPQATGNRRNGVTCANCKTNNTTLWRRNNQGEPVCNACGLYYKLHNVNRPISMKKEGIQTRKRRPKNSSVGNPASAAGQVRMGLPSYQYQDIEVQQDQYQLPVSVYSQRPQVSYRHYGAENIGTINAQPLQPIITHEDEQASVITSTSQQARFRTKVEEDEGSNPSMQS

SEQ ID NO: 11455 - protein, 983 aa, Phyllotreta nemorum
MNTDRLTIFAANLQVSFLLFESLRAHLKYQLECYLKKLTEIMRSESNKVSYEHKEIALDNLLQLWRVPGFHAELYVNYDCDMYCANLYEELTELLAERAVSNVGVYHSHLLSLDGLLIIIDGIGKRFDEAKDRSDTDEISSYTGENTRVKGCVRAPDKKVLAAKKGIKKWLPQGTEYFNQKPKKGIQFLQEHGVLKQELDVEEIARFLRENPALNKAMIGEYISNRGNLKILEAFVGTFDFTGIRIDEALRAFLETFRLPGEAPTISLILEHFAEHWHKSNGEPFADVDSAFTLAYAVIMLNVDQHNENAKKQTIPMSPNAFKKNLKGVNGGDDFEEEMLDEIYTSIKSEEIVMPSERTGLVRDNYLWKVLLRKGRSPEGGVYMRDDAGAYDSELFSIAYGPLAAALNSVYERAEHEGVLKKVMRGFERCASIASNLNMTANLDMLLVSLAKFTVFHNHQKQTAVVVQFGSNAKAQLALKTLFMLIHQHGNSTREGWKHLFDLLLALYSNDLLSKGFVEVEDFVEPSGKLCLVYKDAPSAAKQDTGLLSSLYSYMISVENLSKIPSPEEQSLIDKARECIKECNLEQMITDSKFLHQQALFQLVDTLIELSRGPELQEGSSYDYNENITVFFLELLVKIVIQNRDRVMTIWDRVRDHVYTLVMNSSLMSYQFLLERSVVGLLRIAVRLMRNEEMSHVVLQSLRMLLLLLKGGVLARISRQMAFGLYEMLKTSAQNIHTTADWTVVFALLECVGAGAKPPRPVLTAEENDAKPKPDEETCSKPDEEGAEKSTKTASQRPQSPMTSITSPVGTPNTGGWIIVSDEDDLQPRQQTLPVHYHLRLDADLSPHDPLSMLKCCESLAFLVRDVAHITPYNFDVCVRCVRTFVEAALKPPTAHQSNVKRSKASKSRKKSPAGSQEEDSSGGDEEEDLPSGYHQVPIQLLDLMHTLPRARLKYSNGGPKKAARYPAKPPCGRKAGVLCCRA

SEQ ID NO: 11456 - protein, 205 aa, Phyllotreta nemorum
MSILAYNGGAMVAMKGENCVAIAADRRFGIQAQTVATNFEKVFEMGPHLFVGLPGLATDTQTVMEKLRFRKNLYELKENRRISPKVFAAMISNMLYEKRFGPFFVEPVVAGLAPDTFEPYICNMDLIGCINEPSDFVVGGTASAQLYGMCESLWEPNLAPEDLFETISQALINAFDRDAISGWGATVYIVEKDKVTVRNLKTRMD

SEQ ID NO: 11457 - protein, 934 aa, Phyllotreta nemorum
MAIGITEIGSRVDRRRRAAASLHQRRRSPNPLFRRSNHAHQNPPILPRTTQRGARVPPRLASGAHGGLRWRRRGRGAAIVTQLSLALADLALQMPDWRTPALDLISRFSAGNNVWPLLEVLTVLPEELESRSVRLGENRRYEVLEDMKLCAPTVNEFLKHCSNLYGRRGSERLATGDRQIDVKILRCFASWISVGAIGPSQLSEDRVVVDVAFDVLKADIRGDEKVNVTGQLHEAATDCICTLLLRLEDNNNHVALETHLFENIVNLEVSYHASVALEDQAKSTDYCRLFTELAESFLGKIVDDGGGGGGDGGGAKRRTVYAVKCLDLVLMCVGHHDYEVAEITFNLWHMLSEELYQKNNKELTELFKPYVERLITALCRHCQMEPDMEGLLEKGDEFKDFRMKVSDLIKDVVFIVGSSSCFRQMFINLQTPGVTWDASEAALFVMQAVAKNVLPTENEVVPKVVEAILNIPSSAHVAVKYTSVLLLGELAEWIEKHPDALDPVLNFLVCCLRSGAEGGGVATAAAAALQNVCTCCGAHMGRHVPILLQLLQQSDSFGIGNTAIIGLLKGVASVVSCGIGSGAETASAVRELCSLQLSPLCSLIENGVRPVKGTLTDPVLWLDRLSSVLRYVNVNVVEGEIHPCKPVIMEIWPILSRAFDTYHSDARIMERCCRSVRFMLRCVARQLQDLLPSLVGQIVNIYCLYGHSCCLYVGSILVDEYAGDATCVQGLLDMLNAFLEPTFRLLQEENGLKNHPDTVDDFFRLCARFVQRAPKAFLSGGPHLAPIIQCALLAATLDHKEANVSVMKFFYDLINQGLSGRGEPDFDERKALVRSLLNEYGQQLVSNLIHSCVFYLHSYMLSEVGDVFVQLLDFDRQITSEWLANGLELLPKQQNGGIMAAKPKQLNDVHASITRSNSSKSVTHALKDLTRLYR

SEQ ID NO: 11458 - protein, 502 aa, Phyllotreta nemorum
MAQRFPGPVSNQVPGGPPPPQRYPQPPPNQGMRQYGQQAFPPRPGYSAPPPSMQSSGGTMIQRPPGAPYSPMRGGPMPPQPVGKRPSDNRNPLQQKNSDYSHGTSKKKKKLADKILPQKVRDLVPESQAYMDLLAFERKLDSTIMRKRLDIQEALKRPMKQKRKLRIFISNTFYPAKEPQPEGPDGPCQEGTVASWELRVEGRLLEDSKNDPNKVKRKFSSFFKSLVIELDKELYGPDNHLVEWHRTLTTQETDGFQVKRPGDKNVRCTILLLLDYQPLQFKLDPRLARLLGVHTQTRPVIISALWQYIKTHRLQDGHEREYIICDKYLEQIFNCTRMKFAEIPQRLNPLLHPPDPIVINHVISVEGGAESKQTACYDIDVEVDDTLKTQMNNFLLSTASQQEIQGLDAKIHETVDTINQLKTNREFFLSFAKDPQQFIHKWIVSQTRDLKSMTDVVGNPEEERRSDFFYQPWAQEAVCRYFYTKVQQKRAELEQALGIRNN

SEQ ID NO: 11459 - protein, 347 aa, Phyllotreta nemorum
MPAATLGSIPHPNNEDCGIRDVWAHNLEDEFRTIRQIVQKYQYVAMDTEFPGVVARPIGEFRSSADYQYQMLRCNVDLLRIIQLGLTFLDDNGKTPGGVYTTWQFNFKFNLQEDMYAQDSIDLLQNSGIQFKKHEDEGIEPLEFAELLMSSGIVLMENIKWLSFHSGYDFGYLIKLLTDNNLPQDETEFFDLLKLYFPTIYDVKYLMKSCKNLKGGLQEVAEQLELERIGPQHQAGSDSLLTFDLLKLYFPTIYDVKYLMKSCKNLKGGLQEVAEQLELERIGPQHQAGSDSLLTGMAFFKMKEMFFEDTIDDSKFSGHLYGLGTSFTVNGTTNNYGNDNGDTTNSS

SEQ ID NO: 11460 - protein, 403 aa, Phyllotreta nemorum
MAEVQKRGASVFEDLSNVEFETSENLDVIEKFKDMKLKEELLRGIFAYGFEKPSAIQQRAIIPVMKGRDVIAQAQSGTGKTATFSIAILQALDLTMRETQVLCLSPTRELAVQIQKVILALGDFMNVQCHACIGGTNLGEDIRKLDYGQHVVSGTPGRVYDMIRRRALRTRSVKMLVLDEADEMLNKGFKEQIYDVYRFLPPSTQVVLISATLPHEILEITSKFMTDPIRILVKRDELTLEGIKQFFVAVEREEWKFDTLCDLYDTLTITQAVIFCNTKRKVDWLTEKMRENNFTVSSMHGDMPQKERDNIMKEFRSGQSRVLITTDVWARGIDVQQVSLVINYDLPNNRELYIHRIGRSGRFGRKGVAINFVKSDDIRILRDIEQYYSTQIDEMPMNVADLI

SEQ ID NO: 11461 - protein, 533 aa, Phyllotreta nemorum
MTAPAAGGDARGRTLAYKDKSKPADVRTSNINAAKAVCDAIRTSLGPRGMDKMIQAGNGEVTITNDGATILKQINVIHPAAKMLVELSRAQDIEAGDGTTSVVVIAGALLDAAEKLLQKGIHPTAISESFQRAALLAVEILQEISTPVEITNRELLIKSASTSLNSKVVSQQSSLLGPLAVDAVLKVVEPGQEQACNLVDVKVIKQLGGTVEDTELIEGIVFSQKSANVSGPKKIEKAKIGFIQFCISPPKTDMDHNVIVSDYAAMDRVLKEERAYILNIVKQIKKAGCNVLLVQKSILRDAVSDLALHFLDKIKCMVIKDVEREDVEFVCKSLGCRPIASLDHFTAENLVTADLVEEVGVGGNRMVKITGIQNAGRTVTLLVRGSNKLVLEEAERSLHDALCVIRCLVRKKALIAGGGAPEIEVALKLAAMANKLEGIDAICTRAYATALEIIPFTLAENAGLNPIQTVTELRNRHAKGETSAGINVRKGTITDILEENVVQPLLVSTSALSFATETVRSILKIDDIVNTLN

SEQ ID NO: 11462 - protein, 381 aa, Phyllotreta nemorum
MEDLYTKYKKLQQTLEFLEVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVQYSDIGGMDMQKQEIREAVELPLTHFELYKQIGIDPPRGVLMYGPPGCGKTMLAKAVAHHTTAAFIRVVGSEFVQKYLGEGPRMVRDVFRLAKENSPAIIFIDEIDAIATKRFDAQTGADREVQRILLELLNQMDGFDQTTNVKVIMATNRADTLDPALLRPGRLDRKIEFPLPDRRQKRLIFSTITSKMNLSEEVDLEDYVARPDRISGADINAICQEAGMHAVRENRYIVLPKDFEKGYKNNIKKDESEHEFY

SEQ ID NO: 11463 - protein, 162 aa, Phyllotreta nemorum; identical to SEQ ID NO: 11350

SEQ ID NO: 11464 - protein, 309 aa, Phyllotreta nemorum
MDDKASCKELDQWIEQLNDCKQLTENQVKTLCDKAKEILSKESNVQEVKCPVTVCGDVHGQFHDLMELFRIGGRSPDTNYLFMGDYVDRGYYSVETVTLLVALKVRYKERITILRGNHESRQITQVYGFYDECLRKYGNANVWKFFTDLFDYLPLTALVDSQIFCLHGGLSPSIDTLDHIRALDRLQEVPHEGPMCDLLWSDPDDRGGWGISPRGAGYTFGQDISETFNHSNGLTLVSRAHQLVMEGYNWCHDRNVVTIFSAPNYCYRCGNQAAIMELDDALKYSFLQFDPAPRRGEPHVTRRTPDYFL

SEQ ID NO: 11465 - protein, 447 aa, Phyllotreta nemorum
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTL

SEQ ID NO: 11466 - protein, 540 aa, Phyllotreta nemorum
MMQPQILLLKEGTDSSQGKPQLISNINACQNIVDAIRTTLGPRGMDKLIVSNRGSATISNDGATILNLLDVVHPAAKTLVDIAKSQDAEVGDGTTSVVLLAGEFLKQLKSYIEEGVHPRIIIKAVRKATQICLEKINSLAVKIDKSKADEYRSLLEKCAATAMSSKLINKQKSFFSKMVVDAVLLLDELLPLNMIGIKKVQGGGLEESMLVAGVAFKKTFSYAGFEMQPKIYKDCKIALLNIELELKAERDNAEIRLSSVKEYQKVVDAEWNILYNKLQKIHESGANVVLSKLPIGDVATQYFADRDMFCAGRVQEEDMKRTLKACGGSIMTTANDLKDEVLGRCQLFEEKQIGGERYNFFKGCPNAKTCTIILRGGAEQFLEETERSLHDAIMIVRRTIKNDSVVAGGGAIEMELSKLLRDYSRTIAGKEQLLIGAMAKALEIIPRQLCDNAGFDATNILNKLRQKHAQGNSWYGVDVNMEDIADNYETCVWEPAIIKINALTAAAEATCLILSVDETIKNQKSEAPPQMGGRGMGRPM

SEQ ID NO: 11467 - protein, 2268 aa, Phyllotreta nemorum
MNSEPQKGVLEKVLQQVENTLNVLADSVLQEQPQLRRKKLEHLINEFVHKRTVTRRLIANGVCSNKAFEWLCEMRFYFDPRQTEVLKQLTIHMANARFYYGFEYLGVQDRLVQTPLTDRCYLTMTQALEARLGGSPFGPAGTGKTESVKALGNQLGRFVLVFNCDETFDFQAMGRIFVGLCQVGAWGCFDEFNRLEERMLSAVSQQIQTIQEALKSQKEAAAEGVATGSISVELVGKQVKVSPDMAIFITMNPGYAGRSNLPDNLKKLFRSLAMTTPDRQLIAEVMLFSQGFRQAEKLASNLPDNLKKLFRSLAMTTPDRQLIAEVMLFSQGFRQAEKLASKIVPFFRLCDEQLSNQSHYDFGLRALKSVLISAGNVKRDRIQRIKEGMTQRGETNIDEANIAENLPEQEILIQSVCETMVPKLVAEDIPLLFSLLNDVFPNVQYTRAEMEGLKDEIRKVCTEEYLVCGEGDERGSAWMEKVLQLYQISNLNHGLMMVGPSGSGKSSAWRVLLKALERFEGIEGVAHVIDPKAISKETLYGVLDPNTREWTDGLFTHILRKIIDNVRGEINKRQWIIFDGDVDPEWVENLNSVLDDNKLLTLPNGERLSLPPNIRVMFEVQDLKYATLATVSRCGMVWFSEDVLSTEMIFENYILRLKNIPLEESEDSFGKKSDLKDDMLSPTLQLQVDVVNLLQPFLGPDGLVVRCLEYAMEQEHIMDFTRLRALSSLFSMLNQAVRNVLQYNHMHPDFPLSSEALDKYIPKCLIYSILWSFAGDAKLKVRSELGDFIRSVTTVPLPSDRNLPIIDYEVTIEGEWSLWSNKVPQIEVETHKVATPDIVVPTLDTVRHESLLYTWLAEHKPIVLCGPPGSGKTMTLFSALRALPDMEVVGLNFSSATTPELLLKTFDHYCEYRKTPNGVILSPIQLGKWLVLFCDEINLPDMDNYGTQRVIMFLRQIVEQKGFYRASDQTWVTLERIQFVGACNPPTDPGRKPLSHRFLRHVPVVYVDYPGETSLKQIYGTFTRAMLRLAPGLKGYAEPLTNSMVEFYLSSQDRFTQDMQPHYVYSPREMTRWVRGICEAIRPLDNLSVEGLVRLWAHEALRLFQDRLVEDTERRWTNENIDAVALKHFPSANCEKALERPILYSNWLSKDYVPVGREQLREYVKARLKVFYEEELDVPLVLFDEVLDHVLRIDRIFRQPQGHLLLIGVSGAGKTTLSRFVAWMNGLSIFQIKVHNKYTADDFDEDLRSVLRRSGCKHEKIAFILDESNMLDSSFLERMNTLLANGEVPGLFEGDEYTTLMTQCKEGAQREGLMLDSNDELYKWFTQQVMRNLHVVFTMNPSTDGLKDRAATSPALFNRCVLNWFGDWSDGALFQVGKEFTNRLDLDKQSWKCPDFFPASCNHISATPNHREAVINACVYVHQTLHKANGRLVKRGSRTMAITPRHYLDFIHHLVKLYNEKRSDLEEQQLHLNVGLNKIAETVEQVEEMQKSLAVKSQELQAKNDAANAKLRQMVKDQQEAEKKKVQSQEIQQQLAQQTVHIKQKKSEVMADLEQVEPAVIEAQQAVKSIKKQQLVEIRTMSNPPALVKLALESICLLLGENASDWKSIRAVIMRDNFINSVVNFNTEDIGDDVREKMKSRYLSNPDYNIDKIYHASNACGPLVKWACAQVEYADMLKKVEPLREELNSLETQAETNQKRGEDVKVLISQLEQSIASYKEEYAQLIAQAQAIKTDLENVQAKVDRSIALLKSLVIERERWEASSETFRSQMSTIIGDVLLSAAFIAYGGYFDQHYRQNLFSTWCQHLTLANIQYRADIARTEYLSNPDERLRWQANALPSDDLCTENAIMLKRFNRYPLIIDPSGQATEFIMNEFKDKKITKTSFLDDSFRKNLESALRFGNPLLVQDVENYDAILNPVLNRELRRTGGRVLITLGDQDIDLSPSFVIFLSTRDPTVEFPPDICSRVTFVNFTVTRSSLQSQCLNQVLKAERPDIDAKRSDLLKLQGEFHLRLRQLEKSLLQALNDAKGKILDDDSVITTLETLKQEAAEIGQKVEETDKVISEIETVSQQYLPLSQACSNTYFTMDSLNQVHFLYQYSLKMFLDVFATVLHNNVKLDGITDYQARLNVITSNLFSVVYERVARGMLHNDRMTFAILLCRIHLKGRPTEPNLDQEFNFFLRGKEGVFSSTNSAIVDGLNSDQQEAITRLSTKLPAFKKLPEQIKDMPEFGAWLQQSSPEQAVPQLWIEEKQLSAVGRGMYQMLVIQAF

SEQ ID NO: 11468 - protein, 671 aa, Phyllotreta nemorum
MPGSSEKKVPELSEVQKKKLTIEETKKSLPIYPFKDDLIQAVKEYQVLIIKGETGSGKTTQIPQYLHEAGFTADGKKIGCTQPRRVAAMSVAARVAQEMDVKLGNEVGYAIRFEDCTSERTIIKYMTDGTLHREFLSEPDLQSYSVMIIDEAHERTLHTDILFGLVKDIARFRPDLKLLISSATLDVTKFSEFFDDAPVYQIPGRRFPVDIYYTKAPEADYVDACVVSILQIHVTQPLGDILVFLTGQDEIETCQELLQDRVRRLGSKVKELIVLPLYANLPSDLQAKIFEPTPPGARKVILATNIAETSLTIDNIIYVIDPGFAKQNHFNSRTGMESLMVVPISKASANQRAGRAGRVAAGKCFRLYTAWSYKHELEEATVPEIQRINLGNAVLMLKALGINDLVHFDFLDPPPHETLVLALEQLYALGALNHHGELTKLGRRMAELPVDPMMAKMILASEKYKCSEEIVTIGAMLSVNGAIFYRPKDKIIHADTARKNFNHLAGDHLSLLNVYNQWRDSDYSLQWCYENFIQHRSMKRARDVREQLVNLMTRVEIEIVSGIEETDNIRKAITSGYFYHIARFSKGGSYKTVKHNQSVTIHPNSALFETLPRWVLYHELVFTTKEFMRQVIEIESKWLLEVAPHYYKAKELEDSTNKKMPKTVGRSKMTD

SEQ ID NO: 11469 - protein, 456 aa, Phyllotreta nemorum
MKVEEVKSTVKTQRISAHTHIKGLGLDEAGFAIPSAAGLVGQEQAREAAGVVVDMIRSKKMAGRAVLLAGPPGTGKTAIALAIAQELGNKVPFCPMVGSEVYSTEIKKTEVLMENFRRAIGLRIRETKEVYEGEVSELTPVETENPAGGYGKTVSHVVIGLRTAKGSKQLKLDPSIYEALQKEKVEVGDVIYIEATSGAVKRQGRSDAYATEFDLEAEEYVPLPKGDVHKKKEVVQDVTLHDLDAANAKPQGGQDVLSMMGQLLKPKKTEITDKLRKEINKIVDKYIDQGIAELVPGVLFIDEVHMLDIETFTYLHRALESAIAPIVIFATNRGRCLIRGTDDVFSPHGIPLDLLDRLLIIRTIPYNKSEMEQIIKLRAVTEGLEIEEEAISSLGEVGTKATLRYAVQLLTPSFLTAKINGRSNILQSDVEEIGTLFLDAKSSAKILTEHKDKFMT

SEQ ID NO: 11470 - protein, 526 aa, Phyllotreta nemorum
MTSIIKVQALSGAKDESPPCYLLQVDDVRILLDCGWDEKFDMEFIKELKRHVHTIDAVLISYPDNYHLGALPYAVGKLGLNCPIYATIPVYKMGQMFMYDLYQSQYNMKEFCIFSLDDVDATFEKVVQLKYNQTVPLKGKGYGITVTPLPAGHMIGGTIWKIMKVGEEDIVYCNDFNHKKERHLNGCELKKLQRPSLLITDAFNATYQQARRRTRDEKLMTNILQTLRNHGNVLIAVDTAGRVLELAHMLDQLWRNKESGLLAYSLAFLNNVSYNVVEFAKSQIEWMSDNLMRSFEGARNNPFQFKYLQLCHSLGELSKVPSPKVVLASSPDLESGFSRELFLQWCSNPNNSIILTTRTSPGTLARDLIDNGGGRTIDLIVERRVKLEGQELDEYERRQRSKYDKLEDEEADSDSDSDIEMLVTTKGKHDILIKQEGKISTGFFKVTKKMYPMYPFKEDKIKSDEYGEIVKAEDYKLAEISAETEDNKENIVIKKEEEEISKHYSFIYLFILFFPRKLQYREININ

SEQ ID NO: 11471 - protein, 760 aa, Phyllotreta nemorum
MPPLEVTANTNNDDSAPINPVVGIIYPPPEVRNIVDKTASFVARNGPEFEARIRQNELGNPKFNFLNGGDPYHAYYQHKVKDFREGKGQEPTPGLSQAVAKLSVSASAQQKQQEILKQVEQPFVPKDPPAEFEFIADPPSISALDLDIVKLTAQFVARNGRAFLTQLMNREQRNFQFDFLRPQHSLFQYFTKLLEQYTKVLIPPKSMEQRLRDEAKSAKAVLEQVKYRAEWLRYQEQQKAKEEEILERERVAYAQIDWHDFVVVETVDYQPFEIGNFPPPTTPEEVGARILIQERIEEGEDIEMQLESDEEDDPSNADDGLSSMQDKTKRKGGDDNRLQDMEEDTSDEDNDDEVGKTSTSSSLIQPPLPPIPDKVLVKKYDPKQAVKVSRPTVGDDYLVSPITGEKIPASKVQEHMRIGLLDPRWVEQRDKQMSDKMNQDTVYAAGSAIDASLKLLAERRTDIFGVGDEETAIGKKIGEEDVRKDEKVTWDGHTSSVEAATRAARANITLEEQIHQIHKVKGLLPDEEKEKIGPKNIGSKKINIQSVITTKPPNPSNQQPKQPVSIIQSSAQPIMPVPTQPTMLAPQPSIMMMPAPPMPTIRPPPLMMPGGVAMGGYSVGPMPGQPGPGMNMAPMKHPGDGPGEEEPPNKKLRNEDSLVPENVFLSRNPSQVSIKISIPVMPEKSEWRLKGQTLSWTLALTESVSNLKAKIQEETNMPPAKQKLFFDGMFFKDSNTLAYYNVTQGAVIQLQIKERGGRKK

SEQ ID NO: 11472 - protein, 327 aa, Phyllotreta nemorum
MPSTEVTTTKVIVHPLVLLSVVDHFNRMGKIGNQKRVVGVLLGCWRAKGVLDVSNSFAVPFDEDDKDKSVWFLDHDYLENMYGMFKKVNARERVVGWYHTGPKLHQNDIAINELIRRYCPNSVLVIIDAKPKDLGLPTEAYQAVEEVHDDGSPTSKTFEHVPSEIGAEEAEEVGVEHLLRDIKDTTVGTLSQRITNQLLGLKGLHLQLRDIRDYLMQVCDNKLPINHQIIYQLQDIFNLLPDINQDAFNNSFYVKNNDQMLVVYLAALVRSIVALHNLINNKLTNRDAEEGKKEEKKDKDNKDKDSKDKDKEKTDKDKEAKKDEKKK

SEQ ID NO: 11473 - protein, 550 aa, Phyllotreta nemorum
MFGGGRAPILVLSQNTKRESGRKVQLENINAGKQIADVIRTCLGPQAMLKMLMDPMGGIVMTNDGNAILREITVQHPAAKSMIEIARTQDEEVGDGTTSVIVLAGEMLAAAEQFLEQQIHPTIIIRQYRQALEDMVQFLEGPLSVPLDRNDKNAIAEVVKGCIGTKFLSKWSDLAVNIALDAVNTVLLEENGRTEVDIKRYAKVEKIPGGSVEDSKILRGVMLNKDVTHPKMKRHIKNPRIILLDCALEYKKGESQTNVEISTETDFTKLLELEEEHVKRQCEEIIALKPDVVFTEKGVSDIAQHFLLKAGITAIRRVRKSDNNRIARACGAVIVNRTEELQESDVGTGAGVFDIKKIGDEYFCFVDECQNPKACTILLRGASKDILNEIERNLQDALQVARNIVLSPRLVPGGGAIEMAVAQRLMQKATHGPYRALAHALEIIPRTLAQNCGANTIRTLTALRAKHANHTETDKPCTWGIDGETGELVDMKVKGLWEPLSVKLQTYKTAVETAILLLRIDDIVSGSKKKGDKEVPTPSQMQQQETKETD

SEQ ID NO: 11474 - protein, 233 aa, Phyllotreta nemorum
MMQTGVRPYYPDYSTVPMERQINPYADNGGSVVAIAGKDFVVIGADTRLSSGFSIYTRNQNKLFPLSETTVLGCSGCWCDTLTLTRILKSRMQMYYQEHNKNMSTTAAAQMLSTMLYYKRFFPYYISNILVGLDNEGRGCVYSYDPVGHCEKATYRAGGSAGALLQPLLDNQIGQKNLQKPSQEDLTQEKAISTLKDVFISAAERDIYTGDSVLIKIITKDGTKEETFDLRKD

SEQ ID NO: 11475 - protein, 299 aa, Phyllotreta nemorum
MFQFGFNMFPDIPRPFNMTYKCYSVAMFPGNERQDVERGGKIIMPPSALEQLTRLNINYPMLFKLVNKKTSRTTHCGVLEFVADEGKVYLPLWMMHNLVLTEGDLVQMESVSLPVGTFSKFQPLNPDFLDITNPKAVLENCLRSFACLTTGDVIAVRYNQKAYELCVLETKPGNAISIIECDMNVEFAAPVGYKEPEQAKKEEEMSVDPADLMPEPSGFVAFRGAGNRLDGKKRKDSSSSDAPSAKPAYVRGIPDYDYQIGTLDFIRRTIAKPKEKEGSDDGDDFKAFSGTGFSLRSRN

SEQ ID NO: 11476 - protein, 540 aa, Phyllotreta nemorum
MSALPGAIAFDEYGRPFIILRDQDKQKRLTGIDALKSHILAASQIAHTVRTSLGPKGLDKMMVSSDGEVTVTNDGATILKMMDVEHEVAKLLVQLSQSQDDEIGDGTTGVVVLAGALLEQAGALLDRGIHPIRIADGFELACQTAVEHLEKIAELFPVSAENTEPLIKVAMTTLGSKIINKCHRQMAEIAVNGVLAVADLEQKDVNFELIKVEGKVGGKLEDTTLVKGVVIDKTMSHPQMPKELKDVKLAILTCPFEPPKPKTKHKLDVTSVEDYRELRLYEQEKFKEIVRLVKKSGATLAICQWGFDDEANHLLLQEELPAIRWVGGPEIELIAIATGGRIVPRFEELSPEKLGSAGLVREISFGTTKDKMMVIEDCSNSRAVTILVRGGNQMLVDEAKRSLHDALCVVRSLIQEPRVVYGGGAAEIACSLAVAAQADQLASLEQYAYRAFAEALESIPLALAENSGFSAIHSLGEIKAKQAASGDPALGVDCMNTGNINMREQHVTESLRSKRQQLLLATQLVKMILKIDDVRQPGSG

SEQ ID NO: 11477 - protein, 113 aa, Phyllotreta nemorum
MANAMDVDSEEIELPTSSSSKGEKKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 11478 - protein, 534 aa, Phyllotreta nemorum
MVSLNPVRILKQEAEDERGEIARLSSFVGAIAIGDLVRSTLGPKGMDKILVSSGRNSGMVEVTNDGATILKSVGVDNPAAKILVNMSKVQDDEVGDGTTSVTVFASELLKEAERLIEQKIHPQTIIAGWRKSVDIARKALLEASADNSADLEAFREDLMNIARTTLSSKILSQHKEHFAKLAVDAVLRLKGSGDLQAIQLIKKTGGCLQDSFLDEGFLLDKKPGVHQPKRVENAKILIANTPMDTDKIKVFGSHIKVDSMAKIAELESAEKDKMKDKVNKILQHKANVFINRQLIYNYPEQLFADAGVMAIEHADFDGIERLALVTGGEIVSTFDHPELVKLGTCDLIEQVMIGEDTLLRFSGVALGEACTIVIRGATQQIIDEADRSLHDALCVLAATVKESRIVFGGGCSETLMATAVARASVNTAGKEALAMDAFARALLQLPTIIADNAGYDSAQLISELKAAHNSGQSTMGLNMEKGEIGDMRALGITESFVVKRQVLISAGEAAEMILRVDNIIKAAPRKRTEDRGMC

SEQ ID NO: 11479 - protein, 279 aa, Phyllotreta nemorum
MFRNQYDSDVTVWSPQGRLHQVEYAMEAVNLGSATVGLKSNSHAVIIALKRASSELSAYQKKIIQIDDHIGITISGLTADARILSRYMRNECLNYKYSLDAYMPLNRLINILGIKMQHCTQRYDRRPFGVGLLVAGYDDNGAHIYQTCPSANFYNCKAMSIGARSQSARTYLEKKLDELNLCSLEDLIKHGLRALRDTLPPEVDLNTKNVSIGYVGKGITFKILEEEETAPYLALIEGEERRGGGGGGGSSEVQADPLRESGDDGPKDPIPTVAMDTTE

SEQ ID NO: 11480 - protein, 870 aa, Phyllotreta nemorum
KKKKKKKKRAICFKFISKMVLKPGSKQEPMEITFNDDDLPYEEEILRNPYSVKHWLRYIDHKKTAPNNETNIIFERALKELPGSYKLWYNYLRTRRNQIKSKCITDPGFEEVNNAFERSLVFMHKMPRIWMDYCTFLTDQCKITRTRKVFDRALRALPVTQHNRIWPLYLKFVQKHDISETAVRVFRRYMKLCPENAEEYIDYLTKAERLDEAAIITAKIVNDDNFVSQQGKSKHQLWNELCELISKNPEKVRSLNVDAIIRGGLRRYTDQLGHLWNSLANYYVRSGLFERARDIYEEAIQTVTTVRDFTQVFDAYAQFEELSLSKRMEEVAGKRNPSEEDDTELELRLARFEYLMERRLLLLNSVLLRQNPHNVQEWHKRVQLYEGKPHEIINTYTEAVQTVDPKLAVGKLHTLWVEFAKFYESNDQIEEARLIFEKASQVPYVKVDDLATVWCEWTEMEIRNENYDQALKLMQRATVMPSRKVAYHDDTETVQSRLYKSLKVWSMYADLEESFGSFKSCKAIYDRIIELKIATPQIIINYVVVLEENNYFEEAFRAYEKGISLFKWPNVYDIWNTYLTKFLKRYGGSKLERARDLFEQCLDGCPSRFAKHLYLLYAKLEEEHGMARHAMAVYERATEAVPENEMFDIFNIYIKRAAEIYGIPKTRQIYEKAIQVLPEDKTREMCLRFADMETKLGEIDRARAIYAHCSQICDPRVTAEFWQIWKEFEVRHGNEDTMREMLRIKRSVQAVYNTQVNMMSAQMLSSAGGSSGTVADLAPGVKDGMRLLEAKAAEMAGSASAAQKSNIMFVRGETQGDNKDKVVNPDEIDIGSEDDEEEEEEVEIPLEKQNVPSEVFGSLKKRGNNEDEDD

SEQ ID NO: 11481 - protein, 302 aa, Phyllotreta nemorum
MANGPIAERNRDATIYVGGLDDKVSESLLWELFVQAGPLVNVHMPKDRVTMMHQGYGFVEFMGEEDADYAIKIMNMIKLYGKPIRVNKASAHQKNLDVGANIFIGNLDPEVDEKLLYDTFSAFGVILQTPKIMRDPETGNSKGFAFINFASFEASDASIEAMNGQYLCNRPISVSYAFKKDSKGERHGSAAERLLAAQNPLSQADRPHQLFADAPPIGMMPMSMAPPPPPLITGMMPPPPPTPGGMPPPPPPVPPPSSFPAGIPPPPLPPSQPPLPPGAPPTMAAVPGGGARPPPPPPWSGA

SEQ ID NO: 11482 - protein, 257 aa, Phyllotreta nemorum; identical to SEQ ID NO: 11369

SEQ ID NO: 11483 - protein, 136 aa, Phyllotreta nemorum [sequence omitted]

SEQ ID NO: 11484 - protein, 530 aa, Phyllotreta nemorum
MAISLLNPKAEVARAAQALAVNITAAKGISEVMKTNLGPKGTMKMLVSGAGDIKITKDGNVLLHEMQIQHPTASLIARASTAQDDMTGDGTTSTVLVIGELLKQADIYIAEGLHPRTLTEGFDKARAKALEILEKLKVPIEINKESLTDVCRTSLRTKLHQNLADLLTDVCVEAILAIKQSDKPVDLHMVELMEMQHKTETDTQLVKGLVLDHGARHPDMPKSLKNCYILTCNVSMEYEKSEVNSGFFYKTAEEREKLVLAERDFIEQRVKKVVELKKALCKGTNKTFVVINQKGIDPMSLDMLAKEGIIALRRAKRRNMERLALACGGTAVNSFDDLQESHLGYAGHVYEHVLGENKYTFVEECKVPQSVTILMKGPNKHTLLQIKDAVRDGLRAINNAIDDKALIPGGGALEVAVNKELLAYKDEIKGKARLGVAAYAEALLVIPKTLAVNSGFDAQDTIVKLQEEARLSAEPIGLDLTSGEPINPKDAGIYDNYVVKKQIINSCSIIASNLLLVDEIMRAGMSSLKG

SEQ ID NO: 11485 - protein, 1041 aa, Phyllotreta nemorum
MSSAGIADSPIDPPAKKRKLDSKNCGPDMANNEASGSSNAGEIDEGLYSRQLYVLGHDAMRRMATSDVLISGLGGLGVEVAKNVILGGVKSVTLHDDALCTVRDLSSQFYLTEADVGKNRAEACCKHLSELNTYVPTKPYTGPLDEKVLQKYRVVVLTNSTRAEQLRISEITHNNDIALIVADTKGLFAQVFCDFGKAFSVVDVNGEPPVSTMIADISNDTESVVTCIDDTRHGMEEGDYVTFSEILGMTELNNCKPIKIKVLGPYTFSIGDTTKFSKYVRGGIVTQVKMPKEVHFKPLKEALQNPEFVVTDFAKFDHPIQLHLAFSTLHKFVEKTGRLPKAWNKDDASEFIALAKSLAVNGSTDTEVNTDILNIFSKCCSGDLNPINATIGGIVAQEVMKACSGKFYPIYQWLYFDAIECLPQDKEEITEELAAPVDGRYDGQIAVFGKDFQKRLGELKYFIVGAGAIGCELLKNFAMMGIGTQGGQVTVTDMDLIEKSNLNRQFLFRPHNVQQPKSATAAKVIKKMNPDVNIVAHENRVGPETENVYNDEFFEVLDGVANALDNVDARIYMDRRCVYYRKPLLESGTLGTKGNTQVVVPFLSESYSSSQDPPEKSIPICTLKNFPNAIEHTLQWARDNFEGLFRQNAENASQYLRDPDFIERTVKLPGVQPLEVLESVKAALIDERPKDYDDCLAWARLHWEDQYANQIKQLLFNFPPDQLTSTGQLFWSGPKRCPEPLVFDINEDLHVDYVIAAANLKAQVYGIPTNRNRCYAKQVVTGIEVPPFVPKSGVKIAVTDSQMAMNGNNVDLDRINQIKQELPSMEELSELTLTPLEFEKDDDSNFHMDFIVAASNLRAANYKIPMADRHKSKLIAGKIIPAIATTTSVVAGLVCLELYKLARSIKSLTPFKNGFVNLALPFFGFSEPIAAPKMEYCGNQWTLWDRFEVQGEMTLAEFLEYFKEKHGLEITMLSQGVCMLYSFFMPKAKAQERLGLTMSEVVRRVSKKKIEPHVRALVFELCCNDADGEDVEVPYVKYNLY

SEQ ID NO: 11486 - protein, 428 aa, Phyllotreta nemorum; identical to SEQ ID NO: 11373

SEQ ID NO: 11487 - protein, 490 aa, Phyllotreta nemorum
MGALETDVEMKNADSPTGLEAGDNKRDKDLNSFTEIREQAKQIEKGIINKESRFILRVLRCLPNTRRKLNGIVLRTLINHIYPAVDRDVLLSFIEESAGELDTTQTKARPATKSPVAEIDTYINLLCLVHLIDTNKLAEAERCSQILMNKITSQNRRTLDLVAAKCYFYYSRVAELTDKLDSIRGFLHSRLRTATLRNDFEGQAVLINCLLRNYLHYSLYDQADKLVNKCVFPETASNNEWARFLYYLGRIKAARLEYSVAHKHLIQAMRKAPQNTAIGFRQTVQKLTVVVELLLGDIPERQIFRQASMRHSLAPYFQLTQAVRMGNLQRFGEVLENFGPQFRLDHTFTLILRLRHNVIKTAIRSIGLSYSRISPQDIAKKLGLDSAEDAEFIVAKAIRDGVIEAILDPQGGYMRSKESTDIYCTKEPQLAFHQRISFCLDLHNQSVKAMRYPPNAYGKELESAEERREREQQDLELAKEMAEDDDDSFP

SEQ ID NO: 11488 - protein, 483 aa, Phyllotreta nemorum
SREDWRKAKELEEARKAGTAPAAVDEEGKDINPHIPQYISTAPWYYGTSGPTLKHQRPQDEKNKEYSDLNDWYKRGVDTSKIVTKYRKGACENCGALTHIKRDCMDRPRKVGAKYSGANIAPDEFIQKNLSLSFDGKRDRWSGYDPSEHKTVIEEFQKVEEAKRQLKSDKLNANEESDDEEKDEDKYVDEVDMPGTKVDSKQRITVRNLRIREDTAKYLRNLDPNSAYYDPKTRSMREDPNPGNDATYHGENFVRFSGDTTNHARAQLFAWEAHGKGVDVHLLAEPTKLELLKKEYEKKKDEVKSNIQGTVLEKYGGEEYLEAPPKSLLLAQTENYVEYSRSGKVIKGAEKEVIRSKYEEDVYINNHTSVWGSYWSAGQWGYKCCHSFIKNSYCLGEAGKSVNAQPTAEINTNEELKEEGQEEEKEKSEAVDKESEESDSSSSSEEEKSKAKSKKKLKKKMKKQKKKQQKKKDKDKEAKMSAS

SEQ ID NO: 11489 - protein, 182 aa, Phyllotreta nemorum
FELGRPAANTKLGTRRIHYVRTRGGNLKYRALRLDTGNFSWGSEGTARQTRIIDVVYNASNNELVRTKTLVKNAIVVIDATPFRQWYENHYILPLGRKKGAKMTPEEEEIFNKKRSKKVQKKYETRQKTAKVEPAIEEQFHTGRLLACLASRPGQCGRADGYVLEGKELEFYMRKIKSKKAK

SEQ ID NO: 11490 - protein, 311 aa, Phyllotreta nemorum
MDRLLRLGGGMPGLTQAPPPSDAPVVDTAEQVYISSLALLKMLKHGRAGVPMEVMGLMLGEFVDDYTVRVIDVFAMPQTGTGVSVEAVDPVFQAKMLDMLRQTGRPEMVVGWYHSHPGFGCWLSGVDINTQQSFEALSERAVAVVVDPIQSVKGKVVIDAFRLINPNMMVLGQEPRQTTSNLGHLQKPSVQALIHGLNRHYYSISINYRKNELEQKMLLNLHKKSWMDGLTLADYSENCSVNEKTVADMLELAKNYNKALEDEEKMTPEQLAIKNVGKQDPKRHLEEKVDILMTNNIVQCLGAMLDTVVFK

SEQ ID NO: 11491 - protein, 387 aa, Phyllotreta nemorum
MTVINKMEVDGPLKGEGFRSYYITKIEELQLIVAEKSQNLRRLQAQRNELNAKVRMLREELMLLQEQGSYVGEVVKPMDKKKVLVKVHPEGKFVVDIDKNIDINDVTPNCRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILKIHSRKMNLTRGINLRKIAELMPGASGAEVKVFCFNLLFIFGFIMVYCCRECALRPACTR

SEQ ID NO: 11492 - protein, 199 aa, Phyllotreta nemorum
MVKLYCISILYKDTTYATWLKSAFDLQSFSFFQRGSVQEFMSFFCKTIVERTIPSSRQSVKEGEYMCHVYVRHDNLAGVVISDHEYPSRVSHTLITKILDEFAAKIPAANWSTLQEKDVTFPQLNTYLAKYQNPKEADAMTKIQEDLDETKIILHNTIQAVLERGEKLDDLVNKSEGLSMQSKAFYKTAKKTNSCCNFT

SEQ ID NO: 11493 - protein, 242 aa, Phyllotreta nemorum
MFLTRSEYDRGVNTFSPEGRLFQVEYAIEAIKLGSTAIGICTSEGVVLAVEKRITSPLMEPTTIEKIVEVDKHIGCAVSGLMADSRTMIDRARVECQNHWFVYNENITIESCAQGVSNLAIQFGDSDDDGAAMSRPFGVAILFAGIDEKGPQLYHMDPSGTFVQFDAKAIGSGSEGAQQSLQEVYHRSMTLEEATTAALTILKQVMEEKLNSSNVEVMTMTPKDLFHMFTKEQVEEVITKLY

SEQ ID NO: 11494 - protein, 385 aa, Phyllotreta nemorum
MTEYWLISAPGDKTCQQTWDTMNNLTSKQNNLSANYKFQIPDLKVGTLDQLVGLSDDLGKLDGFVEQVTRKVAQYLGEVLEDQRDKLQENLQANNTDLPSYLTRFTWDIAKYPIKQSLRNIADIISKQVGQIDADLKTKSSAYNNLKGSLQNLEKKQTGSLLTRNLADLVKKEHFILDSEYLQTLLVIVPKAQFNEWNATYEKITDMIVPRSSQLIIQDHDYGLFTVSLFKKVVEEFKLHAREKKFIVRDFTYNEEELAAGKNEITKLVTDKKKQYGPLVRWLKVNFSECFCAWIHVKALRVFVESVLRYGLPVNFQAILIHPNKKQAKRLRDVLNQLYGHLDSSAALSGPNVDSVDIPGLGFGQSEYYPYVYYKINVDMIESKV

SEQ ID NO: 11495 - protein, 557 aa, Phyllotreta nemorum
MSILASPLSVAGSRTTGASVRTQNVMAASTIANVVKSSLGPVGLDKMLVDDIGDVTVTNDGATILRLLEVEHPAARVLVELAQLQDEEVGDGTTSVVIIAAELLKNADELVKQKIHPTSIISGYRLACKEACRYIQDHLTIPVEELGKESIVNVAKTSMSSKIIGADADFFSQMVVDAANAVKVTDAKGNSMYPIKAVNVLKAHGKSARESFLVAGYALNCTVASQAMPKKILNAKIACLDFSLQKAKMKMGVQVLITDPNQLEGVRARELDITKERIQKILATGVNVVLLSGGIDDLCLKYFVERGAMAVRRVKKADLKRIAKATGAAFVTSLSNMEGEETFDASMVGEAAEVVQDRISDDELIVIKGPKARTAASIILRGPNDFYCDEMERSVHDALSVVKRVLESKSVVAGGGSVEAALSIYLENFATTLSSREQLAIAEFAKSLLVIPKTLAVNAAQDATDLVAKLRAYQNSSQTKKDHAHLKYVGLDLIEGTVRDNRKAGVLEPTMSKVKSLKFATEAAITILRIDDMIKLDAEQKGGKNYHDAMNSGELYD

SEQ ID NO: 11496 - protein, 255 aa, Phyllotreta nemorum
MFNSSHSAPPPFWSNGPAPGAFYNFPGTEWKPATNPITHTQSPVTTSTSIVSITYDKGVLIAGDLLASYGSLARYKNCPRVIEINPNIILGAGGDYADFQYVKSFIEQKIIDEDCLDDGLKMKPKSLYCWLTRIMYQRRSKLDPFWNNLVVGGIQDGVPFLGTVDKLGTAYTDKVICTGYGAHIALPVLRDALDKKPNLNLNEAKQLIKKCMEVLFYRDARSYPKYQLGMIDADEGVKIEGPIAVEENWNIAYMT

SEQ ID NO: 11497 - protein, 701 aa, Phyllotreta nemorum
MEFSKEPNFELLATKDFSPEKYVKKLSQNYVGGSELQNLRRKIQGLSEETSSNLKKNVYENYIQFIETAKEISHLESEMYQLSHLLSEQKALLNCLSATSILEDVQPVNIDRDNKVNVKDLEEENKQKIAAILEKVEGCQELLKVPGRFFLYEGDLLEIEPTENTALKIVHVYLFTDSFMITTRNSNSRGLMKYIYESIYDLSSLAVVNVRDLGNVKHAFKLLIFPDTRVFQCSSNSNKKEWLDKFDQAKKTKLAQEQQKRESVSEKSPTRVSFESPSYNPFDEAEEETGASHPEWFVEIPEELDVCVAQRHFEDAISLLQKAKEYLARTSSTSGDKRDTVFTDIQRKVEQRQNNLTEVLMKELEVNPDKSLQGGLRAARRAVRLLNQLGRETQSCTLFLKLCSSMLRTQCKRVKREGSTTTYIKHLSSVVFTNMCHMSDEFLRAFPDSPACASAYVVWASNELLQFTTHFIKQVFMPQTSLSTVTECVVLVRHQCERLYVYGLDLCYQLDGALRSSLLKALKDARDKLIDSIKLRVLDDKWIPINLHTKSALSRYVHEYSQMGLVNVGSYVSGDTWLQLTASTLSFTKMFLNLLNDCMKLKTTELMYTIDETLYNVFETQIRHNENALRSELNQDQRNFLTKNAEFLLVSLMQVVQKKYEENVGYECPTLAKLQKEYVALQKGVTPASRSTKAKYSSEFI

SEQ ID NO: 11498 - protein, 1266 aa, Phyllotreta nemorum
MSNFLCRSLKRCELYALSILKIKLILHLKFNTMNELEKLEYLSLVSKICTELDNHLGMNDKDLAEFIIHLSEKNNTLESFKKVLSENGAEFSDSFVSNLLRIIQHMKPKKSSNKEEADKVEKEGLAFKFPGLAIPNEKQIPLQFEELDEENKNDEIDVVADMMKQLEADAPSHKQTKEKSRSPSVERKSRVRSRSRSKEKRRSRSRSKDRRRSRSRSRDRRRSRSKDRHSRRDKRHRSRSNEDYKRRRTENSYSRDRRERGRSRESERRDRNRSRDDRKRERSRSRTRRRERSNEKKFKSEKDNPEFEDDPTPGKIYNGKVSNVVPFGCFVQLEGLKRRWEGLVHISQLRAEGRVTNVSDVVSRGSKVKVKVLTITGQKVSLSMKDVCQTTGKDLNPLSHATTEREDKDRNPDRPMNNSTSVLRLPVSIDEGEEDSRKRVTRMSSPERWEIKQMISSGCIDKSELPEFDDETGLLPKDEDGEADIEIELVEDEPPFLQGHGRAVHDLSPVRIVKNPDGSLAQAAMMQSALAKERREQKMLQREQEVDSQPSGKNKNWIDPLPEDESKSMARGIGLQTQDLPEWKKHVIGGKKSSFGKKTNLTIIEQRQSLPIYKLKEELRKAVTENQILIVIGETGSGKTTQITQYLAEAGFTARGKIGCTQPRRVAAMSVAKRVAEEFGCRLGQEVGYTIRFEDCTSPETMIKYMTDGMLLRECLMDLDLKQYSVIMLDEAHERTIHTDVLFGLLKQAVMKRDELKLIVTSATLDAVKFSQYFFKAPIFTIPGRTFPVEVLYTKEPETDYLDASLITVMQIHLREPPGDILLFLTGQEEIDTACEILYERMKSLGPDVPELIILPVYSALPSEMQTRIFEPAPPGSRKVVIATNIAETSLTIDGIYYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLCKMLIMSVALQCSDEILTIVSMLSVQNVFYRPKDKQALADQKKAKFNQPEGDHLTLLAVYNSWKNNKFSNAWCYENFVQIRTLKRAQDVRKQLLGIMDRHKLDVVSAERNTVRVQKAICSGFFRNAGKKDPQEGYRTLVDSQVVYIHPSSALFNRQPEWVIYHELVQTTKEYMREVTTIDPKWLVEFAPAFFKFSDPTKLSKFKKNQRLEPLYNKYEEPNAWRISRVRRRRN

SEQ ID NO: 11499 - protein, 415 aa, Phyllotreta nemorum
MATKRKNKKNILAKVNFPLYTVQMLTSRHVIVGGGGGTSKTGVENGFEIYEIFHDGHKFSAKEVTRHETGGNVVMNCCAFSDKKNAFLVAGQENYSQLYKINTKLVEHEEVETIGDTASVRHRNTKPKEHVDNNKNIKKELVFDLNPLDCIQTDFKGSEPLCRVLRINHSGKILATGGTDGDVRLWKFPMMQPLSILKGHTKEIDDIDFSKYDNLIITLAKDGLAILWDAQTGKMKSKLTWKTPEGSKYMYKRCRFGVIEDQKNKCMLYMIANATNSKQASFLQQWIPEENTLKKFSEFNETLSALAVRDDGRFVAVGTMFSGSVSIHIAFSLQKILVVVGAHSMFVTGLEFLSHENTNHSISSVAETAVLSISVDNQLCIHSVPYRRSIPLWIGIMVLVLVLFITFMLCAFMGL

SEQ ID NO: 11500 - protein, 413 aa, Phyllotreta nemorum
MAGAMLFERAQSVPSQHDKLLKLNPTDEDDEEDIVNKEQDILNLGEKYKKEGKAKELAELIKATRPFLSLISKAKAAKLVRSLVDYFLDLEAGIGIEVQLCKECIEWAKEERRTFLRQSLEARLIALYFDTGMYTDALQLESTLLKELKKLDDKNLLVEVQLLESKTYHALSNLPKARAALTSARTTANAIYCPPKMQAALDLQSGVLHAADEKDFKTAYSYFYEAFEGFDSVESPKALTALKYMLLSKIMINSPEDVQQIVSGKLAIKYAGKDIEAMKAVAQAAHKRSLADFQLAVKQFKHELEDDVIVRAHLGTLYDNMLEQNLCRIIEPYSRVQVEYIAKTIKLPVLQVEKKLSQMILDAKFHGILDQGDGVLIVFEETPVDKTYEMALETIQSMSKVVDTLYQKAKKLS

SEQ ID NO: 11501 - protein, 578 aa, Phyllotreta nemorum
MASRSKKSSTPSAQQRPASPLSPTRHSRLQEKAELQHLNDRLAGYIDKVRFLEAENNKLSREIQTTQETVTREVSNIKSMYDHELGDARKLLDDTHREKARLEIDVKRLIEENEELKAELAKKSKDLVVAENHARIYESRCNEYQLKSNQASADAKKAIADAKELEKERDKLKKLLDAARKQLEEESLARVEVENHNQSLREELTFKDQIHQQELTETRTRRQVEISEIDGRLAQKYEAKLQEALQDLRDQYESQMANNRQEIELLYEQKIKNLQAAADRHQSTASGALDELRQVRSRIDTFSSKIDDLENQNRGLAARNRDLEKLLENERIRHAEDLALVERELHRLREEMAQQLQEYQDLMDIKVSLDLEIAAYRKLLEAEEARLNITPTGVEHEVHHRSSSQRRTPVRMGAKRKRALLEETQESSMSDYSVNSSSKGDIEVAAVDPDGQFVRLHNKSNQEVPLSGWQVIRRAGDEETFYKFHRTVKVEGNGTVTIWSSDLNKDHEPPSNLVMKGQKWVTGDNMITIVLNNNGEEVASSERVKRQISTSHLRHRELGDEELYHQQGDLQGEKCGLM

SEQ ID NO: 11502 - protein, 741 aa, Phyllotreta nemorum
MADSKSPDDLATAILRKKDRPNRLLVEEAVNDDNSVVALSQAKMDELQLFRGDTVLLKGKRRKETVCIVLSDDSCSDEKIRMNRNVRNNLRVRLSDVVSIQPCPDVKYGKRIHVLPIDDTVEGLTGNLFEVYLKPYFLEAYRPIHKDDVFIVRGGMRAVEFKVVETDPAPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSEAALQQIREKMDLIDLEDDQIDAEVLNSLAVTMENFRYAMTKSSPSALRETVVEVPNVTWDDIGGLANVKKELQELVQYPVEHPDKFLKFGMQPSRGVLFYGPPGCGKTLLAKAIANECQANFISVKGPELLTMWFGESEANVRDIFDKARSAAPCVLFFDELDSIAKSRGGNVGDAGGAADRVINQILTEMDGMGAKKNVFIIGATNRPDIIDPAILRPGRLDQLIYIPLPDEKSREAIFKANLRKSPVAKDVDLVYIAKVTHGFSGADLTEICQRACKLAIRQSIETEIRRERERALNPNVAMDVSIYHVFKSYIKKMCFLCAAG

SEQ ID NO: 11503 - protein, 274 aa, Phyllotreta nemorum
MSDQFDCALDLMRRLPPQQIEKNLSDLIDLVPSLCEDLLSSVDQPLKIAKDKDSGKDFLLCDYNRDGDSYRSPWSNTYYPPLEDGSMPSERLRKLELDANLAFDQYREMYFEGGVSSVYFWDLDHGFAGVILIKKTGDGSRKIKGCWDSLHVVEVQEKSSGRNSHYKMTSTAMLWLQTNKQGSGTMNLGGSLTRQIEQDAAVNDINPHIANIGRMVEDMENKIRNTLNEIYFSKTKDIVNSLRSVQPLTESRQQQALKQDLAAALQRRQNKSEN

SEQ ID NO: 11504 - protein, 671 aa, Phyllotreta nemorum
MERPPRNEPPVEPVNGVVQPPVHPPPDSPGRVTNQLQFLQKTVLKAVWKDKFAWPFHQPVDAKKLNLPDYHRIIKQPMDLGTIKKRLENNYYWTGKECIQDFNTMFTNCYVYNQPGEDVVVMAQTLEKVFLTKVADMPKQEVVVEIPMKGKKGRVSVGGGGGGSTPSSSGPVPAAIPGGVRGRPPATVSSTSTTPIATTTGSSGLPLGTQAPATLPGSTATTTIAPANNNNSSLTPQQLGTPVTTMHGTPGAPLSNSLDPTGGVLPGNVMPPAQPAKVKKGVKRKADTTTPATAYDYPTVLESKSAKISTRRESGRQIKKPARREIDLHVPQPAIHKPNDKLTESLKACNEILMELFSKKHSNYAWPFYQPVDAELLGLHDYHDIIKRPMDFGTVKEKMDNREYRTPQDFAADVRLIFSNCYKYNPSDHDVVAMARKLQDVFEVKFAKIPDEPVNRIGGVVNNLPIKSESSSSGSSSDSSSESEDSEEERRNKQLKVLEKELTALQEKMRKLVEESSRRKKEKKKNKMKKKPSGAGALTAAGALPNSSSGLGLRGNKPAAASNAAPKRAKANNKTGAGRKKNAAQPPPMPFDSEDEDNAKPMSYDEKRQLSLDINKLPGDKLGRVVHIIQSREPSLRDSNPDEIEIDFETLKPSTLRELESYVASCLRKKP

SEQ ID NO: 11505 - protein, 407 aa, Phyllotreta nemorum
MSLSTARPLVSVYNEKSEEVKGSGVALPAVFKAPIRPDVVNFVHQQVSMNHRQPYSVSDKAGHQTSAESWGTGRAVARIPRVRGGGTHRSGQGAFGNMCRGGRMFAPTKPWRRWHRRVNVNQRRYALASAVAASGVPALVMSKGHVVDQIPELPLVVSDKVQEMRKTKEAVQFLRRIKAWADIQKVYKSQRFRAGKGKMRNRRRIQRKGPLIVYYKDQGLRQAFRNIPGIDLISVQKLNLLKLAPGGHVGRFIIWTESAFQRLDKLFGTWKNPSTEKKGYNLPQPKMSNTDLSRLLKADEIRAVLRAPQKKVVRRVRRLNPLTNTKAMLKLNPYAAVLKREAILKNQKRQLQRDEALAKKRGITLTPDNAVIRTRKLQERRRAQILKDRKSKPKKAAKAPAKPAGKK

SEQ ID NO: 11506 - protein, 1789 aa, Phyllotreta nemorum
MADYINSEAEESSEEEELDHRDRKKAQKAKLVDSSDEEEEEDDEEKIREELKDLIDDNPIEESDAESDASGREKRKKSDDEDLDDRLEDEDYDLLEENLGHKVERRKFKRLRRFDDDESEGEEEHDPEQDRDQIAMDIFSDDDEERRSERSQRPVVEQESFGVGEEEEEGDYSDADDFIVDDDGRPLIEKKRKKKPIFTDAALQEAQETFGVDFDYDEFSKYDQDEYEDEEDEEEDEYEEDDNERRKHPKKAARKKLTKKSIFEVYEPSELKRGFFTDLDNEVRNTDIPERMQLRDVPITPVTDDSTELEDEAEWIYRQAFCNKAISNVDAHLSAEAREKMKKGSQTVGKIKKALDFMRNQQLEVPFIAFYRKEYVQPELNINDLWKVYKYDAKWCQLKSRKENLLKLFDKMRHYQLDQLIKNPDAPIPDNVRVMKDSDIERLKNVQTAEELNDVHNHFILYYSGDLPAMHAAWRIKEREQRKYEKRQKRLRQIAEAEEGAEIPDEPEDDDDDEPETETLKYANRSGSYALCSKAGLDPLAKKFGLSPEQFAENLRDNYQRHEVDQEPVEPSEVAKEFISPKFSTVDEVLQASKYMVALQIAREPLVRKCVREVYFERARLSVYPTKKGQKVIDESHNCYSMKYLKNKPVRDLNGDQFLKLCLAEEENLLAITINDNIEGNTSNSYIEEVKQLYIKDEFSKNVQDWNALRMECVERALTKSVLPDLRTELKRTLLSEAKEFVLKACCRKLYNSIKIAPYSITFPDEDEDEWDTSKGVRVMGLAYEPEYTVSAFACIAAPDGDITDYLRLPHILKRKNSFRTEEKLMKEADLQALKNFIFLKKPHVIAIGGESREALMIADDLKALINELVESDQFPEIKVEIIDNELAKIYANSNKGQADFRDYPELLRQAISLARKMQDPLIEYSQLCNGDEEILSLRFHPLQEQIAKEELIEALCLEFVNRTNEVGVDINLAVQQAHKSSLVQFVCGLGPRKGQALLKVLKQTNQRLENRTQLVTACHMGPKVFINCSGFIKIDTNSLGDSTEAYVEILDGSRVHPETYEWARKMAVDALEYDDDEGANPAGALEEILETPERLKDLDLDAFAEELERQGFGNKSITLYDIRAELNCRYKDLRQPFHSANPEELFDMLTKETPETFYIGKLVTASVIGIARKKPKPDQLDQANPVRNDETGLWQCPFCLKNDFPELSDVWNHFDAGACPGQATGVKLRLDNGIMGYIYIKNISDKPVSNPEERVGVGQLISCRIIKIDVERFSVDCTSKSSDLLDKNHEWRPPRDPHYDTEREEKDNRTEAEKKKEKQRLTYIKRVIVHPAFHNISYAEAEKCMVNMDQGEVIIRPSSKGANHLTITWKVADNIYQHIDIREEGKTNAFSLGKSLLIGNEEFEDLDEIIARHVTPMAAHARDLLYFRYFKDFEGGHKDKAEEYLKDEKKKNASKIHYVVSAAKHIPGKFLLSYLPRNKVRHEYITVTPEGFRFRQQMFDSITSLFKWFKEHFREPPPGGITPGTPRMSTGRTPYDMSTEAIQRVAQNLPSDMVQALSAATNQTPHYPHTPGGYGGNYINTPYTPSGQTPYMTPYQTPHAQQTPRYGQQTPSQPSLSNPFLHPGAVTPSQRTPSYRNLPTQSPMIPQSPVPSPGSQSSYSSHMSHHTRASYGDSLRFQPPESPRNYPSSRGSYPDGRYGGSESMDWQKAAEAWASRSKSTPRSEGRGTPRSSGHRTPRNYDNLSESERSRMKHMSSKSPKSVRSTPRTNSSPRSMSLGDATPLYDENI

SEQ ID NO: 11507 - protein, 861 aa, Phyllotreta nemorum
MPEVDSSESRSPRRKRRRSKSADRKEEKSSKRKSSRKRSSDDEYNERDYPRYYGEDRPNSDSYWNKYPRRDNTKVGRRYYDHPDHQKNRDRDVSNERSRDRDRESTREKKEENEDKSIIKPRERKVVDMLTSRTGGAYIPPAKLRLMQESITDKSSAAYQRIAWEALKKSVHGYINKINTSNIGIIAREILHENIVRGRGLLCKSIIQAQAASPTFTNVYAALVAVINSKFPNIGELLLKRLVLQFKRGYKQNNKSICISATTFVAHLVNQRVAHEILALEILTLLVETPTDDSVEVAISFLKECGQKLTEVSSKGITAIFEMLRNILHEGQLEKRIQYMIEVMFQIRKDGFKDHAAVTEELDLVEEEDQFTHLIMLDDVKEANAEDILNVFKFDEHYEENEGKYKTLSKEILGSDSESDTGSEGSEEESEGEDEDEEVKDAGKIIDNTETNLIALRRTIYLTIQSSLDFEECAHKLLKMELKPGQEIELCHMFLDCCAEQRTYEKFYGLLAQRFCQINKIYIEPFQQIFKDTYATTHRLDTNRLRNVSKFFAHLLFTDAIGWEVFEIMKLNEEDTNSSSRIFIKILFQELAEYMGLGKLNARLKDETLQQHFAGLFPRDNPKNTRFSINFFTSIGLGGLTDELREHLKNVPKTLEIKTAVVKEESDSSSSSSSSSASSSSSSEEESSDDSSGDSSSEDEKQKEKSKKKKKKLDSERSSKSDSKSNRKAEKRDTSKHMKKRDKEDNKEAHKNKENRSDADKHASREKQNSRQDKRKDDGDSKEKHRKDDREDRERQRRNEEKGGRKKDYEWIKSRHEDNIHQLKTTKKVFEKSSKHRSRSRDKISSKEKDRRHRSKERRKS

SEQ ID NO: 11508 - protein, 622 aa, Phyllotreta nemorum
MQHLLRSFSQSAPIIIFILFFSMINPVPNTEFCSITEIMNEVIKHKPSKKNGPAVAQPHSAGGVDWRILVVDQLAMRMVSACCKMHDISAEGITLVEDIMKKREPLATMEAVYLITPSEKSVHALMNDFESPRPMYRGAHVFFTEACPDELFNKLSKSHAAKYIKTLKEINIAFVPTESQVFSLDSPDTFQCSYDPSFAAARNANMERMAEQIATLCATLGEYPHVRYRSDWERNVELAQLIQQKLDAYKADEPTMGEGPEKARSQLLILDRGFDCVSPLLHELTFQAMAYDLLPIENDVYKYEASAGVQKEVLLDENDELWVELRHQHIAVVSQSVTKNLKKFTDSKRMTQSDKQSMKDLSTMIKKMPQYQKELSKYATHLHLAEDCMKAYQGYIDKLCKVEQDLAMGTDAEGEKIKDHMRNIVPILLDTKITNEYDKMRIIALYAMTKNGITEENLSKLGQHASIKDKQTIANLQLLGVNVINDGGPRKKQYTVPRKERITEQTYQMSRWTPVIKDIMEDCIDDKLDQKHFPYLSGRAQTTGYHAAPSSARYGQWHKDRGQQAVKNVPRLLVFVVGGISFSEIRCAYEVTNAQKNWEVIIGSSHILTPEGFLSDLATLAG

SEQ ID NO: 11509 - protein, 712 aa, Phyllotreta nemorum
MMQQYMKELEQEPFDAEEFVERLAWRTLAESKSDGEENEINPALLHESFVQAIKDLNLLHERQQKKCEKLEVAVREDEATFFQEIYNLLEQNKQAMDTFQELDGKINHVATKVLHLGDQLDSVNGPRSRVVDALSLMTHLREFLSNEPVSSTIFTNGEYIDEAADVIQKLYLISQDLPPKFESIKRKIERKYSDIEKTLIEEFVGAMDNENLTRMKEIALVLSQFKGYSQCVDAYIDHSQVGCLSSKDVFYNFLNLCKYNDEIIRKVFKNPEQVMAKFVLNIYQLKLVEYIDQKLNSKLGTYSYLQTLYELYSKTNNLSNELSVFHMGNDKNYLTKLTTNIYNKYINDYISMELKCLKDRCSASLQKYYDSKNHQKKQIQSGGFQDLRRDLQAVIGTRANINIAQIENYGGETFVSEELAIMILQDTKQAFQRCLLLSKGSEKASNATQILDRLINSLLIEHVDYAVELGLQAVPVVEGVRNPPVLYFFNVVHQSNNITHLVEKQFMDLVVPLVENTPKYSDCIQKKKFVLEDIERKINTGLDRCLSAILNWVKLYLQSEQKKSDFKPESDDFDTVASPACKNVLNYVNSIIKEIKTNLDGNNVTAFLQELGIRLHRVVYEHLLQYQYNTAGAMVAICDLNEYRSCTKQLGPLVAELFDTLHALCNLLLVKPENLQQVCSEDSLAKLDRAILHSFIQLRSDFKVQKQTILKV

SEQ ID NO: 11510 - protein, 270 aa, Phyllotreta nemorum
MDFQNRPGGKTGGGGVASWSETNRDRRERLRQLALETIDLQKDPYFMKNHLGSYECKLCLTLHNNEGSYLAHTQGKKHQANLARRAAKEAKDAPSLLQPEKPRVEPKKFVKIGRPGYRVTKQRDPETGQQSLLFQIDYPEISDLVTTRHRFMSAYEQKIEPPDRKWQYLLFAAEPYETIAFKVPSREVEKTDTKFWTHWNRDTKQFFLQFAFKNENKRNVNAVVQRHSIVGGVPPPPMLPVPPPPRPPMFNPIPPPPPMMRAILPVPPPN

SEQ ID NO: 11511 - protein, 133 aa, Phyllotreta nemorum; identical to SEQ ID NO: 11398

SEQ ID NO: 11512 - protein, 442 aa, Phyllotreta nemorum
MATNLSRTSLLRVLNARGYSACPHPLSGIPNAEVKSTVLPNKTVVAAVDNNASLTRVSIVFRAGSRNEDHENLGVAHLLRTAAGLSTKNCSQFAIIRNIQQVGANLTATSDRETICYTLEGTPEAVECAIPFLTEVATQQEFRPWEVSELSSRLQLDIATRPLQLRAVDLLHNAAFRGRGLGNSLFIPKTQIGKISTETLQHYVCSNFLSGRTAVVGSGISEKDLTSFANSLKIENGEGETAPSPYVGGELRSNKGGELAFIAVAGEGAALKNHKEALAFAVLQGAIGGGPQVRHGVSDNGIFRKALGSNPNVSSVAINASYSDTGLFGLLLAVPTKSARGAIESAVKVLKSGTVSDEDVSRGKNQLKASILFNAESGADIVRTLGQEAVLTQKVTSVDARLAEVDSVSTSDVANALKKAGKKLSLASVGNLAGVPFLDELK

SEQ ID NO: 11513 - protein, 110 aa, Phyllotreta nemorum
  misc_feature (94)..(94): Xaa can be any naturally occurring amino acid
MRRSHAGNYYEPLPQNSNEIEDENDRMTNELQEKIGVLKSLTIDIGNEVKYQDRMLRDVDDDLEKTGGFLGTTMNKVLRLSKGGHNYIIVYLFXFSIVVFFILYFVIKFR

SEQ ID NO: 11514 - protein, 496 aa, Phyllotreta nemorum
MSFPSTINAKQAAHEHVLAVSRDFVSQPRLTYKTVSGVNGPLVILEDVKFPKFNEIVQLKLADGSLRSGQVLEVSGSKAVVQVFEGTSGIDAKNTMCEFTGDILRTPVSEDMLGRVFNGSGKPIDKGPPILAEDYLDIQGQPINPWSRIYPEEMIQTGISAIDVMNSIARGQKIPIFSAAGLPHNEIAAQICRQAGLVKVPGKSALDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHSDVSNQLYACYAIGKDVQAMKAVVGEEALTPDDLLYLEFLTKFEKNFITQGGYENRTVFESLDIGWQLLRIFPKEMLKRIPAATLAEFYPRDSRH

SEQ ID NO: 11515 - protein, 500 aa, Phyllotreta nemorum
MNEIRERERAGIRVPDELRAMLLEFTCSYLLEQPEDVVSYAQEYFTKFKESRGTALIYDQDMYDQETMGIKTVLARQIFDSRGNPTVEVDITTDLGLFRAAVPSGASTGIYEALELRDNIKTEYHGKGVNQAIKNINTIIAPELIKAGFEVTQQKEIDEFMIKLDGTENKSKLGANAILGVSLAICKAGAARKNVPLYKHIADLAGNKDIILPVPAFNVINGGSHAGNKLAMQEFMILPTGATTFTEAMRMGSETYHHLKKVIHAKFGLDATAVGDEGGFAPNILNNKEGLELIKVAIQNAGYTGKIDIGMDVAASEFFKEGKYDLDFKNPNSDKSKWIPSDELEALYQEFIKEYPIVSIEDPFDQDDWAAWTKLTGNTKIQIVGDDLTVTNPKRIQTAVEKKACNCLLLKVNQIGTVTESIEAHLLAKANGWGTMVSHRSGATEDPFIADLVVGLSTGQIKTGAPCRSERLAKYNQILRIEEELGAGAKYAGKAFRKPQ

SEQ ID NO: 11516 - protein, 806 aa, Phyllotreta nemorum
MSYMQTNQNRPMSQGYHQGGNDLPMQSSKEQTLLWQQNSYMGDSGIQSGAATQVPSLSGKEEEEMDLFDLDQPYQGFTQEQVDEMNNQLNHTRSQRVRAAMFPETLDEGIEIPSTQFDPNHQTAVQRLAEPSQMLKHAVVNLINYQDDADLATRAIPELIKLLNDEDQVVVSQAAMMVHQLSKKEASRHAIMNSPQMVAALVRAISNSNDLETTKGAVGTLHKLSHHRQGLLAIFKSGGIPALVKLLSSPVESVLFYAITTLHNLLLHQDGSKMAVRLAGGLQKMVALLQRNHVKFLAILTDCLQILAYGNQESKLIILASQGPIELVRIMRSYDYEKLLWTTSRVLKVLSVCSSNKPAIVEAGGMQALAMHLGNPSTRLVQNCLWTLRNLSDAATKVDGLESLLQSLVQVLQSSDVNVVTCAAGILSNLTCNNQRNKVTVCQVGGVDALVRTIVSAGDREEITEPAVCALRHLTSRHVESEMAQNAVRLNYGIQVIVKLLNPPSRWPLVKAVIGLIRNLALCPANHAPLREHGAIHHLVQLLMRAFQDTQRQRGSVASGGSQPPGTYADGVRMEEIVEGTVGALHILARESHNRAIIRQQMVIPIFVQLLFNDIENIQRVAAGVLCELAADKEGAEMIENEGATAPLTELLHSRNEGVATYAAAVLFRMSEDKPQDYKKRLSMELTNSLFREENLWNPDLGMGPDLQDILSPDQAYDNMYAQGPPSVHSSHGGRPYQQQGYDQIPIDMQGLEIGSHGGGNGSTYSAIDAMDVTSGEPDLNFDTIDQLPTPPQDNNHAAAWYDTDL

SEQ ID NO: 11517 - protein, 266 aa, Phyllotreta nemorum
MARNAEKAMTTLARWRAAQLGEIDKHKKRRPYLASECKSLYACEKWRMQIIREIAKKVAQIQNAGLGEFRIRDLNDEINKLLREKRHWEDQIKELGGPDYQRVGPRMLDHEGKEVPGNRGYKYFGAAKELPGVRELFEQEPPPPPRKSRAELMKDIDADYYGYMDDDDGILIPLENKAEKIAVQKAISDWVSNKEKNLDSSKGIEESIYVVEESDEEDAVQQFDGSQQRFVAHVPVPSQQDIEQALLRRRKQELMEKYGVQDEQDV

SEQ ID NO: 11518 - protein, 214 aa, Phyllotreta nemorum; identical to SEQ ID NO: 11405

SEQ ID NO: 11519 - protein, 117 aa, Phyllotreta nemorum
VLNLICIILYRTGYQGSFLGVGGTWNLNEEKNPDAEIVASGIFVGFMIYTVVSLISFCFASGDHKTSFTDILMNIVGVFMWVAVGATALHYWLGYLSEYKYSTVDSERQVSLSMQQY

SEQ ID NO: 11520 - protein, 841 aa, Phyllotreta nemorum
KLIFKMPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEEGEDAVDDPRKLKPGEIDPNPETKPARPDPKDMDEDELEMLSEARARLANTQGKKAKRKAREKQLEEARRLAALQKRRELRAAGIEVNSRRKKKRGVDYNAEIPFEKQPAIGFYDTSNEALDLMAPDFSKMRQQHLDGELRSEREERERKKDKQKLKQRKENDIPQAMLQNEEPAKKRSKLVLPEPQISDQEMHQVVKLGKASETAREIATESGVETTDTLLNDYMFTPQAAATPRTPAPQTDRILQEAQNMMALTHVDTPLKGGLNTPLHNSDFSGVLPQSQAITTPNTVLATPFRSSRSDGGATPGSTAGFMTPKSGALTPVGKNATPSVRDKLNINAEESLDVASTPAEHRMYQMSMKDQLKLGLSSLPQPRNDYEIVVPENEAQDEPEEAQSQLVEDQADVDARKQEELRAKAAQELASRSQVIQRELPRPQEVNLTVLRPPNESYSLTDLQRAEELIKCEMVTMLQYDNLKNPLPAQSKRSNMSQAQQLAFLEQHPYDSFKQEDLEVAKTLLRSEMEVVKNGMNHGELPLDVYNQVWEECLSQVLYLPNQTRYTRAHLASKKDRLESAEKRLEQNRSHMAKEAKRAAKMEKKLKILTGGYQSRAQVLIKQLQDLYESIDQSALELNTFKFLAEQEKNALPMRIQSLTEDVNRQMEREKVLQKKYADYQDQIKQLQEEYLVQMQGVPNEESNKYDEVTSTTNEENVMDTSENDNDKIVAEN

SEQ ID NO: 11521 - protein, 157 aa, Phyllotreta nemorum
MMQFMLLFSRQGKLRLQKWYVAHPDKLKKKITRELITTILARKPKMCSFLEWRDLKIVYKRYASLYFCCAIEQCDNELLTLEIIHRYVELLDKYFGSVCELDIIFNFEKAYFILDELLLGGEVQETSKKNVLKAIAAQDLLQEEETPQGFFDDHGLG

SEQ ID NO: 11522 - protein, 416 aa, Phyllotreta nemorum
MYGLQRYSFRYTLKNAVRYYSREPAKRSSFLSRLYDNFKDEMNKNKEMKESLKKFREEAQKLEQSDALKAARQKFETVEKEASKGGEVFKESLGSIKERVKGVIDEASKSDLAKKAGKFTEEVGKTTHKISETAQEISKTGAFQSISEATKAVKQEIDNTSMEGRVYVSPKKLRKRTETSAVVQQKYYEPNTDATGVELHKDSKFYESWQNFKNNNPYVHKVMDWKLKFDESENPIIRASRALTEKVGDIMGGLFQKTELSETLTEICKIDPDFDTKRFLKQCETDIIPNVLEAMTRGDLEVLKDWCHEGPFNLFAVPIKEAYKKGYKIESKILDVDHVDLVMGKVMDQGPVLIISFTSQQVMAVRDASGTVVEGDPDKVMRVNYVWVLCRDVVEPDPRAAWRLLDLSASSNEQLV

SEQ ID NO: 11523 - protein, 302 aa, Phyllotreta nemorum
MSSSDSELSDSDAELQQALLDGKLKPGLNKIEEAPKQFVNNISGLNQKIEEFKLKLPWIERLDCTNAQAPLAPELAAEMLVHEEKRSNQLRNNKKLPQFQPSEDPVLNDFKRELIFHRQAQATILEAIPKIKEFGLPTKRPDDYFAEMAKSDEHMHKIRENLKQKQEQQKRIERVKQLRQQKKEGKSLQVQMKLQRSKEKKEMMDQVKKARKNFDFLDDKNKPMGKKAAEKRKMKDKKFGFGGKKKGMKKNTKDSAGDISEYRNPGKPAKKQIGNKFVNKNKPKNQRLGKNRRIKTKAKGKK

SEQ ID NO: 11524 - protein, 1266 aa, Phyllotreta nemorum; identical to SEQ ID NO: 11498

SEQ ID NO: 11525 - protein, 616 aa, Phyllotreta nemorum
MNPGAPNYPMASLYVGDLHSDITEAMLFEKFSSAGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDESGVSKGYGFVHFETEEAANKSIEKVNGMLLNGKKVYVGRFIPRKEREKELGEKAKLFTNVYVKNFGEDLSEEQLRTMFEKYGKITSYKIMSKDDGKSKGFGFVAFESPEAAESAVEALNGKELLEGKPLYVGRAQKKAERQQELKRRFEALKMERLNRYQGVNLYVKNLDDTIDDERLRKEFSPFGTITSAKVMMEEGRSKGFGFVCFSSPEEATKAVTEMNGRIVGTKPLYVALAQRKEDRKAHLTSQYMQRMANMRMHQMGQFIQPGGSSGYFVPTIQATAPRFYGPAQMPIRTSPRWQAQTPVRPGAQGGTAAYAGMQNSYRAAARPPGQSTMRSNISVPRPITGQQPPSVAAAGNRAANFKYTANMRNPPQALLPGAQAQVQQAVHIQGQEPLTATMLAAAPPQEQKQMLGERLFPLIQRMYSDLADVAGKITGMLLEIDNTELLHMLEHQESLKNKVEEAVAVLQAHQAKQAAIKKD

SEQ ID NO: 11526 - protein, 901 aa, Phyllotreta nemorum
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSGLVEDQGFLEQLKELLSDSNPMVVANAVAALSEINESSPTGQPLVELSTNTINKLLTALNECTEWGQVFILDSLSNYTPRDEREAQSICERITPRLAHANAAVVLSAVKVLIKMMEILAGDTEFCNTLSKKLAPPLVTLLSSEPEVQYVALRNINLIVQKKPDILKHEMKVFFVKYNDPIYVKLEKLDIMIRLASQVNIAQVLSELKEYATEVDVDFVRKAVRAIGRCAIKVEPSAERCVATLLDLIQTKVNYVVQEAIVVIKDIFRKYPNKYESIISTLCENLDTLDEPEARASMVWIIGEYAERIDNADELLDSFLEGFGDENAQVQLQLLTAVVKLFLKRPQHTQGLVQHVLSLATQDSDNPDLRDRGFIYWRLLSTDPAAAKEVVLADKPLISEETDLLEPTLLDELICHISSLASVYHKPPTAFVEGRSAGIRKTLPARQGSDEGATAAETTVIPNQESLIGDLLSMDINAPAPAAAAPAAPQTSNIDLLGGGLDVLLGGGTDIPASAATAAAPTTTGLLGDIFGIPTAPTMYTPPKVIWLPAEKGKGMEIYGTFSRRSGQMAMEMTITNKAMQAMSGFAIQFNKNSFGITPSSPLNIPTLQPGQNLEYSLPLNTTGPVQRMDPLMTLQIAIKNNVDVFYYACQIPIQILFGEDGTLDKRVFLTTWRDIPGANEVQYTLNDIKGNTDTVSNKMTLNNIFTIAKRNVEGQDMLYQSLKLTNNIWVLLELKLQPGVPTATLSLKS

SEQ ID NO: 11527 - protein, 165 aa, Phyllotreta nemorum
MPPKFDPTEVKYVYLKCVGGEVGATSSLAPKIGPLGLSPNKIGDDIAKGTADWKGLKITVQLKIQNRQATISVVPSAASLIIKALKEPPRDRKKVKNIKHSGNITFDEVIALAQQMRPRSMAKALSGTVKEVLGTAQSVGCTIDGKAPHDVIDEVNEGTVEVPDE

SEQ ID NO: 11528 - protein, 364 aa, Phyllotreta nemorum
MSEEGKRALILVGGYGTRLRPLTLSRPKPLVEFANKPILLHQIEALVDAGVTEVILAVSYRAKQMEEELTVEATKLGVSIVFSHETEPLGTAGPIALAREHLSKSTKPFFVLNSDIICDFPFRELAKFHEGHGKEGTIVVTKVEEPSKYGVVVYDENSCIESFVEKPQEFISNKINAGLYILNPSVIDRIELRPTSIEKEVFPYMAKDKQLYAFELKGFWMDVGQPKDFLTGMCLYLNHLRETNSQKLYKGPGVVGNVLVDPTAKIGSNCQIGPNVTIGPDVVIEDGVCIKRSTILRGAVVCSNSWLESCIVGWKCHVGKWVRMEGSTVLGEDVIVKDETYINGGQVLPHKSIATSVPEPQIIM

SEQ ID NO: 11529 - protein, 304 aa, Phyllotreta nemorum
MKNKKKKKKKKKPNLNMASDGEEVISDQEKVKIVSDFILHSPPGEFNEVFNDVRKLLNNDDLLKEGVTGAFAQYNKDQLTPVRIENADQMVLITEYNDLGNNRFFDPRSKQSFKYEHLRKEASDYQPYSVDTTAEPWRAALDNEFIQYTRNHYKDGVCSVFGRSQNGAITLTACIEDHQFQPKNFWNGRWRSQWSVSLTDESTAEVRGVLKVQVHYYEEGNVQLVSTKEIKESIPVSNEAQTAKEIIHVIENAENLYQTAISENYQTMSDTTFKALRRLLPVTRTKMDWNKIVSYSIGKELKTQ

SEQ ID NO: 11530 - protein, 1365 aa, Phyllotreta nemorum
MSAKMLVKMNFLLVLIISAVAQEGVAPDVAGQDNTGDVETIGVGAAGGDDSRPVPVGENDGTVTNSPNYDAPEVLTNRDSTNSSRPNWTFQKKTKSGKYITFYAPNYDPMTSDTAPQDTDQRGGGIPYSITETRLAEIRKNFMYPFYDKGGNVDNEGDYQKEIQSSTPQVHKNLNFQLPFFGFRYNYTRVSINGYLEFSDPPSNLNYPLVFPIKDWPKQNDPAFIGIFYSKCKIGNLRDEDVDKRKPGVYFRMERDLRDRQDRMGVEIRERLKWDIREGVIGSDTFNPKHAIIVTWKNVSFNGGYANAVYQTNTFQMVLATDEVFTYAIFNYLNIDWTSHTESGGDTRKGEGGVPAFVGFNAGNGTRSYQYAPYSQASVIRDLTSTGWGNNKPGRHIFRIDENILLGSCNKDIDGANLPLQFAPESGNMLGGTVVNITGPCFNPNDRIRCKFDVYDEVVGYVVDRNRAICIQPRLYAEGWVRLQIAINSEAFKWKGKYYVESPASASQKIFFKDMKYHEKSPSEIRITWQKQNLTTNENANIRISLWGYRETTMRPTFVYITEIADNVQNTGEYTIVPSQYRGKVNQFLSDIKFGFLQINLTESIKVNTYTTNNQNVDITPIIWSRPIPLGWYFQFQWENQYGKNWPKYLCDDWLRTDRYLKNFAHELPQCPCTVQQALADKGKFMPDFDCDKDSNPVCYYNNQALHCVKTGAPTMEGSEQQCCYDKNGYLMLSYDQQWGSSPRRCHNLGKMPYNEATKVPTLSQWFNDVVPKYLCCLWQEEQAVGCETLRFERRPSQDCVAYQAPAVAGVYGDPHIVTFDDVEYTFNGKGEYSLVKSVKVDDNLEIQARFEQMDPNAYGEVRATQLTAIVAKGNKTIPIEVRRRPPEARWRYRLDVIAENRRLYFDRPSLKFQHFQGVTVYTPTYILNQSEVLIMFDNGAGVEVLDNQGYMSARVYLPWSFINKTVGLFGNWSFNKEDDFTLPDGSKAAVASNINDMERVFNDFGSKWMLDDVSDANKGQSLFYREFGRTSATYNNKTFRPQFLMLPEDILPPNRSEQIQRTYDVCSTKMYECYYDYAMTLNRDLAHFTQNYKATIYELKQTTREKITSCGVLETPRFGRKSTFLFVPGTKVTYECIQDFVLIGDPRRECKADGKWDTPEFGYTYCLRQEEYSSRQAAIASGIVLAILIPLILLFLYLGYKIYKRLFGNDDGSWKYQSTAQKSGGPQTFRRSFSPYRDEDDDDIPQSPSDSNSLPKKRRSYEKSYRTHEPLTDRPSIEFEDKPLDPNDPNYDDIDRTSAAPSSPASPTSPTSSVQYTTPYNARPDVLLGNSDGNLGYTENDYAMPIKRPKNRFSHSQSSIVTDV

SEQ ID NO: 11531 - protein, 89 aa, Phyllotreta nemorum
  misc_feature (89)..(89): Xaa can be any naturally occurring amino acid
MRYVAAYLLAVLGGNASPSAADVEKILGSVGVEAEAEKVKKVLGELNGKSIEELITKGREKLSSMPVGGAAPVAAAAVAAAPAAAEEKX

SEQ ID NO: 11532 - protein, 907 aa, Phyllotreta nemorum
MMTDRFGLKWDPKNLEIRTMSVEKTLEPLVLQVTTLVNTKGPSKKKKGKSKRANALVSTVEKATENFIEKGEQIAYENPDITDEMIAAVEEVRKTGNAMSIAAREFSEDPCSSLKRGNMVRAARNLLSAVTRLLILADMVDVHLLLQSLHVVEDDLEKLKNASSHGELLDNIKAFGHNANELMNQAAKRQQELKDPQLRDDLAAARAVLKKHSTMLLTASKVYVRHPELAAAKANRDYVLKQVCEAVNTINDVAQGRTPQPASGPYDGPGELAAALDDFDDHMVMEPLAYNEVHTRPSLEERLESIISGAALMADSSCTRDERRERIVAECNAVRQALQDLLSEYMTNMGKKDKSDNLNRAIDNMGRKTRDLRRQLRKAVVDHVSDSFLETNVPLLVLIKAAQNGNEKEVEEYAVVFTEHSNKLVEVANLVCSMSNNEDGVKMVRYAAAQIDNLCPEVINAARILAARNRSKVAQENMEAFKQSWENQVRILTEAVDDITTIDDFLAVSENHILEDVNKCVLALQEGDADTLDRTASGIKGRSNRVCNVVTAEMDNYEPCIYTKRVLEAVKVLNDQVMPKFTQRVQVAVQALGNSPPKEVDENDFIDASRLVYDGVREIRRAVLMNRADEDLDPEDVELDENYLIETRSKSSAHTGEHGVDEYPDISGITTAREAMGKMPEEDKQKILQQVEFFKSEKLKFDREVAKWDDTGNDIIVLAKHMCMIMMEMTDFTRGKGPLKTTMDVINAAKKISEAGTKLDKLTRQIAEQCPESSTKKDLLAYLQRIALYCHQMNITSKVKADVQNISGELIVSGLDSATSLIQAAKNLMNAVVLTVKASYVASTKYPRQGTVASPIVVWKMKAPEKKPLVRPEKPEEVRAKVRKGSQKKVQNPIHALSEFQSPTESV

SEQ ID NO: 11533 - protein, 417 aa, Phyllotreta nemorum
MSFNFGNTSAPKPAATGFTLPSNPATTSATGLQFNFGGGDTKTEVKPSSTLFPTATSAAPAPAFGIAPKPATPSSAAAAAPSFNFGTPTTQQTTASAFGTTTPASFSTPNASTLQFVTSRPQTDVSGLFGSTATAAATPISASTGLSFGTTVSTTPVSATPAATGTPLFGAAPTSSSTTTISSVPALGLSTTVSSAASTTPSTSLSNTTSAPPPAYSASTLPSTGSLTFSQLEDSINKWTIDLEEQGKFFINQAKQLNAWDSLLISNGEKILNLNGSIERVKQQQQQLDQELDFVLAQQKELEELITPLEKELLEIPVTDIDRNQMYQFSEIIDSQLKQMSDDLKEIIEHINESNKSEEISNPLTQISRIMNAHMNSLQWLDRNTAQIVSHLEQISKMQDSNRRNFPLNHSFNNSLL

SEQ ID NO: 11534 - protein, 193 aa, Phyllotreta nemorum; identical to SEQ ID NO: 11419

SEQ ID NO: 11535 - protein, 187 aa, Phyllotreta nemorum
MDPIMGLEKQIEALELQALQNEDESQIKSKIHAITGLLLQTRMMINSALSCREALTSMLQPLTTVNDYLNPSTSSNDVEVEAKRQYLLESYPELIGTVQTIGTFESLLPFLGSINISKVVEFCEILEELASNNTELYGECRDVIKEVLGALQDYNDISNSIKALLSQWDFTISNLEHALQPKFLDVP

SEQ ID NO: 11536 - protein, 583 aa, Phyllotreta nemorum
MSNAKFQEVYSDLTLYTTPDKFFIEPKAGEELMVIERNSENIICFKSDHRHLIPAANSRKDFCGLIGIIQLLACPYLVIAVQRELVGYIAGCAIWRLAKAELIPYRSSAHLTPEKQADNDVYLSMVYSVLSTPFLYFSYDYDLTHSLQRLHGISPDFWKQSLFERADQRFVWNGNLLYSFKGFSIHRFCLPLMHGFVSINFCVVNGHSLNWSIVSRRSVQRAGTRLHRRGLDKEGNVANFVETEQIVEYQGDRASFVQIRGSIPLFWQQDPDLRYKPPPTLLDVDPQDQHSMCLKHMNDLMTLYGKVVCVNLVDQKGAEGNMEVAFKDAVSNVSSPSVKYESFDFHAECSKMRWDRLSILIDRLAHDQDEMSFFLLLRDGSLSSLQDGVFRTNCIDCLDRTNVVQSMLAHRNLEGVLRKLQILHQNQTLEFQYSFEVLFKNVWADNADIISTQYTGTGALKTDFTRTGKRTHYGLLQDGINSVTRYYKNNFADGLRQDAIDLFLGHGKPVSPLHIDKGWKYVTYPSILLIAVAMFVACAVTPSEYSTDSLLFLLFWGSMVYATLHTIFKYGSEFVDKPRLTQS

SEQ ID NO: 11537 - protein, 498 aa, Phyllotreta nemorum
MPPTIQQNNQNAANGVEKRQVKTVEKRSDLLCKVKYCNTLPDIPFDLKFITYPFESIRFIQYNPTSLERNYKYEVLTEHDLGVSIDLINKDIYAIGAGASLDPADEKLLEEDILTPQDSKRSRHHAKSVSWLRRTEYISTEQTRFQPQTMDKVEAKVGYSIKKSLNNETLYMDRDSQIKAIEKTFEDTKTIIDKHYSKPNVVPVDVLPVYPDFSLWKYPCAQVIFDSDPAPVGKQVPAQIEEMSQAMIRGVMDESGEQFVAYFLPTEETLQKRREDVANQVQYQDDEEYEYKMAREYNWNVKSKASKGYEENYFFVVRSSGIYYNELETRVRLSKRRQKVGQPPSNTRLIVKHRPMDANEFRMQRYREKQLEPTGEDDEEMEIDEPQDEENVLEPDNGKETESDNEKKRSRASSVSSQRRSRSRSNSSAKSNSRSSSRSASKSRSRSRSKSSSRSRSRTPSKSPTRSRSASKSPSRSRSPSSARSKSASSSGSNSDSE

SEQ ID NO: 11538 - protein, 389 aa, Phyllotreta nemorum
MPIENLEDQGLEKNPDLELAHYKFLLTLPEYRSDRNVHSKITEAIKKDDMAPWYELLCKEVGWKLDSALLKTLKAKNAEKVKLLDEAIEDAEKNLGEMEVREAYLRKAEFYSRIGDKENAVSTFRQTYDKTVSLGHRLDIIFHLIRIGLFFMDHDLITRNIDKAKTLIEEGGDWDRRNRLKVYQGAYCMSVRDFKTAANLFLDTVSTFTSYELMDYKAFVRYTVYTSIISLPRNQLRDKVIKGSEILEVLHSEPFVKDYLFSLYNCQYAEFFSNLAEVETILRKDYFLNPHYRYYVREMKISAYTQLLESYRSLTLQYMAEAFGVTIEYIDEELSTFIAAGRLHCKIDRVGGIVETNRPDLKNAQFNSVVKQGDLLLNRVQKLSRVINI

SEQ ID NO: 11539 - protein, 2775 aa, Phyllotreta nemorum
MEELTSGLDPDDLMDLDEPEGSDLEDDDEDLIDDHVSSPFISSSAPESTANSVASSPIHEDFPPPFNFTGKPLHVKRGRGRPRREGGKPSAPRTTRGGGTGVSRVRRPRPPGFSRRGSLGGSRSVRQVERSDYEMSLFSGSPVDDGMLDPETGSMIFPEKFVPAIEEPPYFPEHWPGKACALCNLGERSQLGQGEMLRLNCPEGFSPEKVISEQILERALQAPDKECGDKSPKGPVTCRRQKSFNKCRHPSITSEYVDELTIIGYNEVPDVSSLFEPNGQFYVHRNCALWSNGVTKAENSALLNVGPVVSQCSSKKCSFCNHYGASLTCHVDKCTKIYHFPCATAAGAFQDVSSLATLCNDHLGQVAMLTNASPCLTCATMGDIANLMFCSGCGAHYHGICVGLAQLPGVRSGWQCRKCRCCQVCRVLGDESKLMTCEQCDKIYHASCQRPIVTSIPKYGWKCRCCRVCGDCGARTPGAGLSSRWHAHYTVCDSCYQQRNKGFSCPICHKAYRAHAHREMVQCSSCKKFVHGTCDPEADVVTYSQKKEISMDYEYVCLHCKNSTARQITAKRASIDDPSDVSASHDSLYDDTSELDLPSPDEFARNMGLGKGKPYSANKIAKKRLSFTVNPVGRPKGTGKVPPGKMGFMKRYRLTEFNRKRGPKAKMRGIFGVPGVGLQRPISDGKTDEEPGVENRLVLCSAKDKFTLTQDICVMCGAFGTDQEGCLISCVQCGQCYHPYCINVKVTKVILQKGWRCLDCTVCEGCGQRNDEGRLILCDDCDVSFHIYCMDPPLDYVPHGNWKCKWCAICQSCGATDPGFNCTWMNSSTQCGPCASHVNCPSCSEPYGEGDLIIQCVQCERWLHGACDFIKCEEDAEKCAEEGYNCILCRPRDVPPPHMVPAAVTPKPPTPTKSPELGKSTSYYMDGVCLSEFGSNLIKSLALEYHGSRKKRKKIPTVQDKEAGIMATIESVVAGGNIIPTNMEDSAKLELVDIKDEPQELYKEGMMWTKEDGPPPEGFTIITMENGLNVLRRKRQRNLQKLGIGGFVVRMRGIRTGQDNDEVDSTIGQSGLNPNDIVPSPADGDKPRRKAIRRKPKSKLAETFPAYLQEAFFGKDLMDTVDCKKEEVDCYSSDDEKTDKHYKSINLSQDEIIAIVASGKTEKLETNNKDSTKEVKPTVLKEEEEDNPEDLKDVLALPGDLLDTDLVNSIMEDEEELSKTTASLVALDSNLPHDTELTDTLSSSGNSKETKDELSDILGPHFNLDSISNINSKDVEDIFKGVLTDESQESQESSSFSLQGNSMFSNNNAQQNVAQHPIINQPVRPKTLPTVNLNLNSPVGFPPPSPYHSEYSNSSPQFSPAFTESSCSWVSGNETPEIDSTNVTVTSTYNQRSSDKMKADESLGKSATISAVLYANINHPEWKKEYPNWPDRYKQIIKKWRTLSQEQKAPFLQHARDNRSQLRMKKAQQSQTVKETASAATSPNASKPLHQAGQALATTLQAVAQQPAGAPAAPAAPVSEDQEKIALQQKSAREAEQERQWKQLQALRQQQTQQTQNILHEQRVQAIARVQRQISTDPAQQFISDQQSPLQVNTPQELSPSTTPAPSPRQFLGIKSPTFPVPSPIQQTGVRANTPSQSPHDIAQPSTPDGNDHFIHSPTNPKPNFQPRLPNDPFAAQPATPRPQFAMARPPLQNFGGTVRNEQQDININRQLRELLQRQQVKKLDELLPGKAPPQRLWHGNDQQEGGDASMTSPVAQGPGAQGTDATFRQPLPPGVVKPRLAISSVNRPVLNAVRVNQLDPRIQNLDPRMRLILQHQQQRLPTGIQQQFIRFASNVRPTTVEQYEQLLQRQGNNQNQIHAEEQQQGVARIPIAQASVIQRPHVAQAAATGAAAATTSSTESNPSEEGIPDNVTAELEKLEQETGTMVELQGVSDILGGLDDDDELLAEMGADFNILEYADPELEALTGGKTNILDLELEEEPVKKEKLASNANTSAPSQKPTPNVTTTAISNSTAVTTPTEANTEPKMDNTIQQSIPKTQPQQLQHPASLPQQQNMPQHNAQVQVQSQQQSQPHPPQQMPIQPTLHIQQIHQQMVHQVQQAAAQGRPMPPGSKMQTTDGFVGVVMANNAVQLQIPPNYQQMVHQVQQAAAQGRPMPPGSKMQTTDGFVGVVMANNAVQLQIPPNYQQRLLLLQQLQNQKLMRVGSTQPRAALQVAPNQMPVGMNPGARMPVAAPPPPPPPYPGPPPPYPGNANQHQQEQPLLLEDLLEQEKREQEKLQNQPPNHEVTSSTGNETESALLSDQDFERLKADVFNSAPVNNISSTNQGNAGQTSQAWPQLQNRQAAVPATASQHTMEVTTRVQMFNPNLIPAPPLPPENIATEQDKQAQLLYEQWLNHQNNTLVQQLRYYETEVQKLRKSKKSLNSKQRQLKKAGNQLTDADATELQRITAEQAILQKHLESSRKQNRQHGMLIQEYRNKHPAIKQRTGTDQIQSPLGHPASSPIQQSSASLSPMLSPSVSPMTQNSSPLNSPGPMVPSSPGHGPVQNILQSPNNANTAQMSPMQSSPRIGTPHSQSDESPGSAQSPSQVCLPPPMPRMTSPQHRRVVTSPVGMSQMRFINNNMLQQRVRMQSPIQNFQQKPGTPSPLNSPTSQQMSVNQQHQIQKQLQQQQQQQTLLQQNLEGDPNAIHSQRTTQLLQHRNFIRQQVSQQQISPQTLTPQQHQLMLQQQKQLAQQQQQQIAQMNAARLQQQQQQQQQNNPPHSPMPPKSPMINQQI

SEQ ID NO: 11540 - protein, 1507 aa, Phyllotreta nemorum
MGDSPQEGRSSRRSKTFKAKASEKFKQFKKGVKNKYEIGEVENVYEVVEEKQYIKEVMSRYDDDWIVGDSSGYIEDGRDIFDDDLDVESVAQASSKGKGLKRKHKNVSENAGKGKLQQMFSTMPTKQKTAAKVDDDEMLSEILGEIDSDTPNTSTVEKPKISQYSSLAINLSAKDYMKNLAQPVKKRAIEKSTKVPKFLPSVSKPIEKVPIKPVPIKPVPDKTVPVEIQNTAKEQVNPDENVEKEIINPAKNVEEEKTDPDTSHLQFDDDLDETLLEEFSEDLNETATTSQTTESEMNGDDFTGEMDTTLIDEIEERINVAGEQLINDIQAEVETEWQYFNAANGMESFKLASESFESSQGPDSPAETMDDIPLEKVEGKNVFRFFWWDAYVDPQHQQGTVFLFGKTYCEASKKYESCCVAVKNIERTLFVLPRPFELDENKKPTDKPVTFKSVHDEFNNQILKRMGIVSFKSRLITKKYAFDPSVPAESEYLEVRYSASFPRIFSNEDVNQKVSDGDIDTDDLGYSTFSKIFGIKTSFLESLFLERKIKGPCWIDISDPEPAANPMSFCKFEVNCLKPTNLKVASFEKPLPPPPLVVATINMRNFINHGSSAQEIVMLSCLVQNQYAVNKPPPEPAFQNHFCVFSCPRGEVLPLNLFDALQNYKITKVLKTDNEKAMLNCFVNNIVQIDPDLIVGHNLQGFQTAILADRLLKSNCRLYNRLSRLKKRSTLSRQLERNLFLGRLVCDIKISAKELIKSRSYDLGTLCQVVLKLKENQRVDLEPEDVMKMFKTSQDLIKLISFTMQDTGYILKMMYNLNIIPLALQITNIAGNVMSRTLMGGRSERNEFLLLHAFHEKGYIPPDKVYRKNEDPESKGSSKKKPTYSGGLVLEPKVGFYDKLILLMDFNSLYPSIIQEYNICFTTLPVMDSDENLVLPDSNLPPGILPTEIRKLVESRRQVKSLMKNPDISKDLKLQYDIRQMALKLTANSMYGCLGFGHSRFYARNLAALVTQKGREILVNTKDLIEKMCLDVVYGDTDSLMINTNILEYDQVFKVGVKIKQEVNKLYKQVELDIDGVFKYLLLLKKKKYAAVTLTKSPSGELIATKEYKGLDIVRRDWSQLSSETGKLVLEHLLSDESSDEKVQNIYDHLAKIKSDLIEGKVPVPLLVITKQLNKSPHMYTDKNSMPHVQVALRYNQKSRDHFRMGDTVPYVICLDGTENGPTQRAYHLDELKNNPNLKVDYDYYLEQQIYPVITRICEPIEGLDSYQLAECLGVNMKRVRKPKIPGSNENIQGENVVDAEVKFKNAEKFTFVCYICKHENVVSEPLIKNVPFLEVCQNPECQSKPIDYLPSVQNQLYRTIRSHITKYYRKILTCEDPSCPNAPRRLPLNFLKKRPICGLCGNAVMYKVYTEFHLYNQLAYYRYMFDLSKLKNKPAMDGETESGYQALQDIVDKFMNQSEYSLINLGDVFSQLGWPVPSQANRKIELEESKTGILFNEEGNGDAYDE

SEQ ID NO: 11541 - protein, 465 aa, Phyllotreta nemorum
MAAAAAAKIAEVRETTRVERIGAHSHIRGLGLDDSLEARHVSQGMVGQVSARRAVGIVLQMVRDGRIAGRAVLLAGQPGTGKTAIATALAHALGQDTPFTSMAGSEIYSLEMSKTEALTQAIRKSIGVRIKEESEIIEGEVVDLSIERPATGVGTKVGKLILKTTDMETVYDLGGKMIDSILKEKVQSGDVITIDKATGKITRLGRSFARARDYDATGQQTRFVQCPEGELQKRKEVVHTVTLHEIDVINSRTHGFLALFSGDTGEIKSEVREQINGKVAEWREEGKAEIIPGVLFIDEVHMLDIECFSFLNRALENEMSPIVIMATNRGITKIRGTTYKSPHGIPLDLLDRTIIVPTQPYDEKELKEILNIRCEEEDCQMSDNALVVLTRICKETSLRYGMQLIMTSSLIARKRKAHEVDVEDIKRAYQLFFDEGRSVQFLKEYQQEFMFNEIDEKDDMEIETV

SEQ ID NO: 11542 - protein, 389 aa, Phyllotreta nemorum
MALRTYGDKPISFQLEENGEYYCVGSEVIFIGIFWICLMIRSNLQVGNYLRLFRGSLYKKYPGMFRRSITNEERRRLIELGLSQHVLASSVSLLRAEEVEDIIEGNDEKYKAVSVHTSEPPMPREGKSKKNMQWVPSLPNSSHLDAVPQATPINRNRVAAKKVRTFPLCFDDTDPQINIENACQQELLVPIRLDMEIEGQKLRDTFTWNKNESLITPEQFAEVLCDDLDLNPLTFVPAIAQAIRQQLDAFPTEPPSIIEETCDQRVIIKLNIHVGNTSLVDQVEWDMSEKQNNPEEFALKLCAELGLGGEFVTAIAYSIRGQLSWHQRTYAFSEAPLPTVEVPFRNPSESDQWAPFLETLTDAEMEKKIRDQDRNTRRIRRLANTTPGW

SEQ ID NO: 11543 - protein, 162 aa, Phyllotreta nemorum
PEVYVPTVFENYVADIEVDGKQVELALWDTAGQEDYDRLRPLSYPDTDVILMCFSIDSPDSLENIPEKWTPEVKHFCPNVPITLVGKKKDLRNDPTTINELKKMKQEPVKPQDGRSMAEKINAFAYLECSAKSKEGVREVFENATRAALQVKKKKKHRCVMF

SEQ ID NO: 11544 - protein, 1338 aa, Phyllotreta nemorum
MNTTTFNPRMDAAQNPVQKMELASRNVENSLLIDNNAPRLIDFMNISPQSGSTASGFADHDYPTLSGLSHIINSMTQIKCVSNVPIPSEIVDHFARVQCHCMMGLFSEINRAWLTVDSDIYVWTYEENTDLAYFDGISETIVCVGLVKPKAGVFHAFIKYLLILATSVDIVVLGVTFTERPGDNADEIQLIPDPVFILPTDGSTVTIITSTDDGRIFYGTKEGNLFEIAYQAESGWFGKRCKKINLSTSTLSFLVPSFINAALSEEDGISQISIDDSRHILYILTEKGSIEVCDLGEKGNSFSRISKMSQNTLVNQAMNTVKTLDSQNFRPIVSISAIEASESVNLNLVAVSQTGVRFYMSVTSLSNQNPNQRPYTLTLAHVRLPPGYSANITVRPRAVHVSQYRDRNLVLISTVNEKDVLWCMSSDLFPFGQGLTEAYTAINLDGPALAISEVRNASPLQIKDLHEAPPLVVRQHAEPPKKYIVLTSHSIQIFIKLRPVDVLKQILKDSHGQDTEALKAFFTIQKEDQACATALILASLENEDNMDIAEFATRAFFLFGGEPKLAAPMNTFSGPSVFCPPVMSTPNIHQYHQQQQQYQTSPQYQHNFPHGISPAANAYELTSPFVFSPKHNGLYLYLSRILRPIWNRRTVDKLCLDGKIVTNHSTVTSEDCIFILNYVTSLHNFLMRNTQLSTLSAAPGQNPQTLNNTTMNMTRLNHTIQDVQLEERASLDALKTFVCHCCQILGLWRILCEHQFHTLIASLPETEQQILQNTTFKDLLLHRHDICTLLIATLVDSYLGDNASVDSISSKLREVCPLFYKTEDAAFSKAVEILKMTRTIQNNDEKEEMIQSALQICKSIGPTINITDICKEFANLKAYKAVTELCAHFGKKIDPDKIAESYYNAEDNSGDQEGYNYYQRRLEIYRHILNMLDQLYNEQNQTQVVSRDPAYSVNQTILLDGVEQSQVGYVMKQVIKDVMETPDEIMHFALYDWLVFKNMTGDLINIQNPSLETYLKRTSTQNPNNIEAMNLLWKYYESCNNHAAAAKILNNLASRTGINVPLKERLSYLARAIMCMRSDKIGYAPYLGVFLRDLEDKMEVAKVQEQILDAIVNLQGQIPNAQEVISALNSGLYEISQLYENFAEPFKLLECQLAIIECAGYTDQVLIESIWQQILTEELRKTYGTGTDKVCQLLNKVKQLSKQYAQSANCFPLSYIVYELEIVNAKLRGDKQLVPCALESMNIPFENLINVYNSLNTISINDHFWQLEENEFHLSEATAALINCFLSHLEQYSSVEKRKITSLCQDAVVALLSNLYSKPNTDVLVNKLRNIQAKLSRI

SEQ ID NO: 11545 - protein, 1379 aa, Phyllotreta nemorum
MSEFTLSYREVTPEQIDFENWKEITLTTGGTQSTLQDIKVAEKANGYCYKDSAKHCTRNRFIYWRINHNVLELVEHSLDINLTGNRIRYKFDTPILDGVSIHEVLDNVVILVPTVCSVHRLIFPHPNVFHAQDDLLGIYPDLTALSIFSKASIVDTRNPNSFYVFNNPSTANDQLPNLANSYFVPETGEAYFILAFPSTELLLIKQSPDQVTCAELKGESLVPRFFAGIADKFRHKNSDSENIVSLLFYDLDEETYVLSLTQDAHLKFWSCSKAQCVAVIDVREKITNLKYRVQSAILKKAEDGNSSENILVLFLSFGNKCQFHVLKPSVRDQEISLHRLATLESPLNDLIDFAAQVDCLWSVWRSDVGETVVYMASFKSNRWTQVILESEPTDKFFPVKCNDVKTLYLQHIFHPGRFPLHVINKTLSIYKMPTIGSDSHMSISALKQRVCMAVENDIQNLFNKDGTDINSVEVDEYVECAEWCWQKFDSCCVQYQIASRKPLGLMLLPSVSGAMLLKKSAFSFLRPVDSLEHMTLSTDLYREQFFNFSMLSDDLDTVEDVINVFKVIVYIEQQLKDDFMQSFETELLNLQSPDVVIEDLLKKIYVEMDSDFFSHILHLIKDVNDLYKAIHKILELLRYENTLSNPDNDINPAAMYYFNSLLGTSLVAQSFRQQAEIRFQICRNLLLLCNFLVMDRTLNGGVLEGVRSVCMPDIVVLTQASYVVLWLSGLTMFESDSVRDSSMSTLNPLKLTPVYNLLPFTRCTSLLEVFISSSGVQDARKSFARVSCKDEALARWHWSLLPYVNHIRHLIWPISGCTVFEEWLLSSGQHVWLQQYVRLLSNWCEWNVCTRNFLLASSFLTTGEFYKAEELFETASKGVFTDTFLQNRIKSVDENNFRTTIHYYLKVIQLFELCNARSHVINVANTALCVVKRDDPLAATLFSIKFKHHLALKHYQLAFDSLNSNPDGERRKDNLRDLVKTLLDEKKLNVLLNFTYGSMDEFFANIVLTRARAADVMNNVFYDFLYSYQIKKGPPSFRLAASAMYEQAFRLSQKTTIEALEKQVKCYLAAKNVLHLCPAQHAWVVRPADPDEEDEQVIFQPLAGSNGEIRTFKIKKQIEVVDIETIGKELTFASAKLKLLQFNPSVSINVCDPLELVISLNNSGMFKTAFEICSTFDLPYSLVFEALTKRCVLLTEAEDPNAWNWLVENDLQDLPVNRESAADVVWKFLQDCLEKYEEPNMSCLHNVVCKKIINMQIYLPHWLKASYKARNPSELLRLLHASGRLEEAFELAKDYILSAMGYGKEEFGFSQPLAPTSPAFCLPVYAIQRLVDELDIQNSMNIEKPYVHEHDDLKVLFSKYLETAIRVSNQMCQVKGKVI

SEQ ID NO: 11546 - protein, 748 aa, Phyllotreta nemorum
MEVSDKNLETLSRYLQETLNPDPNVRRPAEKFLEGVEVNQNYPLLLLNLVHKPEVDMTIRVAGSVAFKNYIKRNWVVEEDQTDRIHESDRLAIKNLIVTLMLSSPESIQKQLSDAISIIGKTDFPLKWPELITEMVEKFSTGDFNVINGVLRTAHSLFKKYRYEFKSNELWTEIKYVLEKLAKPLTDLLVATINLSVTHSNDVAALKIIYSSLVLICKVFYSLNFQDLPEFFEDNIQVWMTNFHTLLSVDVKALQSQEDSEAGVLEQLKSQVCDNVALYAQKYDEEFQPYLPQFVTDVWSLLVATNLQPKYDLLVSNALQFLSSVAERSQYRNLFEDDNVLSSICEKVIIPNMEFRTSDEELFEDNPEEYTRRDIEGSDIDTRRRAACDLVNTLSQNFEQRIVEIFGRYLQVMLAKYAENPKEYWRSKDAALYLVTSLVSRGSTQKHGVTQTSQLVDITQFCQQHILPELERPDVNDLPVLKADAIKYVMTFRSVLPSDLVVSTLPQLIRHMPSESCVVHTYAACTLEKILMLKFNNQPIVTGAELEPLASELLTNLFAVLQKPVSEENEYIMKALMRTFATLQDRIIPYLNVALPKMTEKLQMVAKNPSKPLFNHYLFECFSLAIKIVCKVNPTAVTSFEDILFPIFQGILQQDIQEFIPYVFQILSLLMENTPQGSLSDPYMQLLPCLLAPVLWERPANISPLVNYWRLSLLKLPLRSCCRIKWAVSWGCSRSCWLRNRTTTKVFG

SEQ ID NO: 11547 - protein, 199 aa, Phyllotreta nemorum
MAKVQLCNITVMDNPSPFLNPFQFEITFECIEELKEDLEWKMIYVGSAETEEHDQVLDSVFVGPIPEGKHMFVFQADPPNVSRIPENDAIGVTVVLLTCSYRSQEFIRVGYFINNEYSDPEMRENLPSPPQFDKVIRNILASEPRVTRFKINWEESSGTQENGTTVAEAPANQTAETSASVEVPAFNENSNSWATMECS

SEQ ID NO: 11548 - protein, 318 aa, Phyllotreta nemorum
MDQMLPSPGFSIPSIGTPLHQPEEDQLILPNAIQQQQQQQQQQSLPTTNSQVPPLAPMGGSTPTLGLGLGHAMSMPHTKYVTGYSLPISSMAPQTPQHTMMSPMVNVGGTGTTSSGVTPTLGPSTPSPMTPMTPHSADPGIVPQLQNIVSTVNLSCKLDLKKIALHARNAEYNPKRFAAVIMRIREPRTTALIFSSGKMVCTGAKSEEDSRLAARKYARIIQKLGFPAKFLDFKIQNMVGSCDVKFPIRLEGLVLTHSSFSSYEPELFPGLIYRMVKPRIVLLIFVSGKVVLTGAKVRQEIYEAFDNIYPILKSFKKQ

SEQ ID NO: 11549 - protein, 217 aa, Phyllotreta nemorum
MMIDYSSFNRYPFLTSHSSAVAVILICHIYNFLTVLGLLKIFEESFIFYLPKSPFKAHKMAAIRSMSRLLFSRSLQTTVKRGYADQMSFTFAAGNQVFYDAKSVKQVDVPSFSGSFGILPAHVPTLAVLKPGVVTVYEDGGSVQKIFVSSGTVTVNDDSSVQILAEEAHPVENLDVSAARDLLHKAQGQLSSATTDQVRAEAAIAIEVGEALVKAAE

SEQ ID NO: 11550 - protein, 323 aa, Phyllotreta nemorum
MSGDGSQNEHFDTLFLSIAQHHPHGPTQLLDTFVNFLSRKTDFFTGGKEGEWEKLVLNTFKKYEKSSREQHAAELKEKLEQEARRKAKKEAESAKQAQITELTEEQAEKLQAELDAKKSPASAAPSNSSDTPSTSTAKIEEDEDESEKGKLLPNRGNGCDLEKYNWTQTLSDIELRVPLKCDFRVKQKDLTVNITKKHLTCGLKGHPPIIDDDFQHEIKLEETNWVIEDGKSLLFSIEKVNKMNWWSKIVKSDPEISTKKINPEPSKLSDLDGETRGMVEKMMYDQRQKEMGLPTSDERKKQDVLKKFMEQHPEMDFSKCKFN

SEQ ID NO: 11551 - protein, 158 aa, Phyllotreta nemorum
MQSPSGMVHGYPQASILQWSPDKKYSDRERWICVYPAYINCKKTIAQGRKLNKDKCVENPTHQEIRDVLVAAGLKVGVENKLYSRERSKELLYRGRIRVQLKNDDGSLCNPNFPTRDAIMLHLGDMIPKLKSRQNKGSGDPQPQTTSSKGKGKGKGRR

SEQ ID NO: 11552 - protein, 656 aa, Phyllotreta nemorum
MEEPEPTKRQKMPKVAKVKNKAPAEIQITAEQLLREAKERDLEILPPPPKQKISDPAELADYQLRRRKQFEDNIRKNRTVISNWIKYAQWEESQKEIQRARSIWERALDVDHRNITIWLKYTEMEMRNRQVNHARNLWDRATVLLPRVNQFWYKYTYMEEMLENVAGARAVFERWMDWQPDEQAWQTYINFELRYKEIDRARQIYERFVITHPEVKHWIKYARFEENHGFIHSSRQIYERAVQFYGDDHLDEKLYIAFAKFEENQKEHDRARVIYKYALDHIPKDETKELYKAYTIHEKKYGDRSGIEEVIMSKRKLQYEQEILQNPTNYDAWFDYLRLVEGEADLETTRETYERAIANIPPSKNKQYWRRYIYLWINYALFEELDAKDYERTRQVYKACLEILPHKTFTFSKIWLLYAQFEVRQKNLTAARKVLGMSIGMCPRDKLFRGYIELEIQLREFDRCRKLYEKFLEFGPENCVTWMKFAELETLLGDTDRARGIYELAINQPRLDMPELLWKAYIDFEISQEEPNNARQIYERLLERTSHVKVWLSYAKFELNNPSEEDFNVRLARRIFERANENLKNFPEKEARVLLWKIGRSSKATTAMTSTRKKSTPRCPGESKRGRRSSTRTAWSKAGKKCLTTYSPKTRPAGLT

SEQ ID NO: 11553 - protein, 476 aa, Phyllotreta nemorum
MGIKFLEVIKPFCSILPEIAKPERKIQFREKVLWTAITLFIFLVCCQIPLFGIMSSDSADPFYWIRVILASNRGTLMELGISPIVTSGLIMQLLAGAKIIEVGDTPKDRALFNGAQKLFGMVITVGQAIVYVMTGMYGDPAEIGAGVCLLIIIQLFVAGLIVLLLDELLQKGYGLGSGISLFIATNICETIIWKAFSPATVNTGRGTEFEGAVIALFHLLTTRQDKIRGLREAFYRQNLPNLMNLLATVLVFAIVIYFQGFRVDLPIKSARYRGQHSSYPIKLFYTSNIPIILQSALVSNLYVISQMLAVKFQGNFFINLLGVWADVGGGGPARSYPIGGLCYYLSPPESVSHILEDPVHAVMYIIFMLGSCAFFSKTWIEVSGSSAKDVAKQLKEQQMVMRGHRDNSMIHELNRYIPTAAAFGGLCIGALSVLADFMGAIGSGTGILLAVTIIYQYFEIFVKEQSEMGGMGALLF

SEQ ID NO: 11554 - protein, 162 aa, Phyllotreta nemorum
MSMVSSSAVELSSYRDQHFKGSRAEQDKLLRLSTTLYVGNLSFYTTEEQIYELFSKCGDIRRIVMGLDKYKKTPCGFCFIEYYNREDAENCLRYINGTRLDDRIVRTDWDAGFIEGRQYGRGKTGGQVRDEYRTDFDSGRGGYGKITQQRIGPMDTPSYFRK

SEQ ID NO: 11555 - protein, 306 aa, Phyllotreta nemorum
MAATVGRICGVGLLKPNNLATIGQIGSYSTAKEWTRGKKALLGTLGMLAGGTGAVLVALDQSVKASDLELHPPKNIWSHSGIFSSLDHASVRRGYEVYKQVCAACHSLRFVAYRNLIGVSHTEAEAKAEAEEQMIRDGPNDVGEMFTRPGKLSDYFPSPYPNEEAARAANNGAYPPDLSYITAARHGAEDYIFALLTGYCEAPAGVVLREGQYYNPYFPGGAISMAQALYNETIEYGDGTPATASQLAKDVSTFLKWTAEPEHDDRKRMLIKVIGIFSFLLGLTWYIKKVKFASLKSRKIEFRPKN

SEQ ID NO: 11556 - protein, 578 aa, Phyllotreta nemorum
MLALQQYSGSSDEEEDKQKSTANNEPSTPSEFSLKSQLAICAAPEVLPTGLEEDQMHIDVDTKELAFNPKYDVLFAPSLGPANPFKTQQQLVERNMLSGHIERAHVSEFQFENQRRTFASYGYALDPSVTNDGQIKVVGSSEADDSSIKTVFEASKTRPLDKRKRKKNDDPSDVDGFLGPWGGFIDEQKISKPTEEEQIELDEISSKKNKKGKPNEDKPLEEKSVLHIKDAVDYQGRSFLHAPQDVGVNLRSDTPPDKCFLPKAHIHTWTGHSKGIAAIRLFPRTAHLLLSAGMDCRIKIWEVYNERRCVRTYYGHRQAVRDINFNNSGKHFLSAGYDRYIKLWDTETGQVLSRFTSRKIPYCVKFNPDKNKQHLFVAGTSDKKIICWDTRSGDIVQEYDRHLGAVNSITFVDENRRFVTTSDDKSLRVWEWDIPVDMKYIADPTMHSMPSVTPAPNGKWLACQSMDNKVVIFSSMNRFKINRKKTFSGHMVAGYACSLDFSPDMSYLTSGDADGKVYIWDWKSTKLFKKWKAHDNVCISVLWHPHEPSKLISAGWDGLIKYWKSTKLFKKWKAHDNV

SEQ ID NO: 11557 - protein, 268 aa, Phyllotreta nemorum
MVQKKPKKKVGKKVAAAPLAVKKVEPKKEVNPLFEKRPRNFGIGQDIQPPRDLSRFVKWPKYIRIQRQKAVLQKRLKVPPPINQVSQTIDKQTATQLFKVLEKYRPETALQKKNRLKAKAEAKVAKKEEAPTKRPNTLRAGTNTVTKLIEQKKAQLVVIAHDVDPIELVLFLPALCRKMGVPYCIVKGKARLGLLVRRKTCATVALTQVDSGDRSNFNKLLEVVKTNFNDRADEIRRHWGGGILGSKSAARIAKLERAKARALAQKQG

SEQ ID NO: 11558 - protein, 333 aa, Phyllotreta nemorum
MATIIKDITLQENIPQNILFKKHIEFIKEYGQKENNFEYAMTDYLRISGMYWGLTALELMNASPPHTIEEISDYIKNCQDPESGGISSCLNHDPHILHTLSAVQILCMYDNLKAIDVEGVVKYVKNLQLPDGSFTGDKWGEVDTRFSFCAVATLSLLNRMDAIDVNKAVEFVASCKNFDGGFGSRPLSESHAGLIYCCLGFLSVTNRLDIVDRDMLAWWLCERQLPSGGLNGRPEKLPDVCYSWWVLSSLTILGKLHCIDAGALKRFILACQDTESGGFADRPGDIPDPFHTVFGISALSLLGNDTVQKVNPTYCMPQHVIDRLQLKPQILDS

SEQ ID NO: 11559 - protein, 888 aa, Phyllotreta nemorum
MHQETLQLIQILEKTVSPDKNELEQASSFLEQASQTNLLGFIKTLSDILRHGGNSPVARMAAGLQLKNQLTSKDSTIKATYQQRWLLFSEEVRDYIKKNVVGALGTETNRPSSAAQCVAYIAVTELPQGQWPDLISTLVSNICNGNSTEMQKEATLEAIGYICQEIESDVLVSQSNDILTAIVHGMRSSEPSNHVRLAATQALLNSLEFTKANFDLTTERNYIMEVVCEATQSPVSQIKVAALQCLVKIMSLYYQHMEPYMAPALFPITLEAMKSENDAVALQGIEFWSNVSDEEVDLAIEDTEATEAGRPPTRVSRHYAKGALQYIIPIILQKLTKQEELDDEDDWNPSKAAGVCLMLLATCCEDEIVPHVLPFIKENIKSDNWRFRDASLMAFGSILGGLEPNTLRPLVEQAMPTLIELMYDSSVIVRDTAAWTFGRICEIIPEAAINENYLKPLLESLITDLKAEPRVAANVCWAFSGLAEAAYEAAAVNEETGTPDTYILSPYYEFIIQRLLETTDRADGAQANLRPAAYEALMEMVKNSPKDCYVTVQKTTMVILERLQQVLQMETHITSHNDRSQFNDLQSLLCATLQSVLRKVTPEDAPHISDAIMTAMLTMFNSNSCKSGGVQEDALMAVSTLVEVLGENFIKYMDAFKPFLYIGLKNHQEYQVCGTAVGLTGDIFRALKLKALPYCDEIMTLLLENLRDQSVHRSVKPQILSVFGDIGLSIGSEFKKYLEVVLSTLAQASQAQVDRNDYDMLDYLNELREGVLDAYTGIIQGLKGDGLTPNPDVMVLEPHIPFIVQFITVVAQDNQHSDGTVAVAAGIVGDLCTAFGSPMVQLLDLASINDMLAQGRRSRVSRTKTLATWASKELRKLKMPAPAAAAAS

SEQ ID NO: 11560 - protein, 460 aa, Phyllotreta nemorum
METILEQQRRYHEEKERLIDAMVKEMLHKKNTYREAINSDHRQKYLLDRYMTSTERLIELYEDKDGQRKAEVAALTGPNEFNEFYSRLKQIKDFYRRHPNEISVPMSVEFDEFAKARENPNEDMANFVEFTDEEGYGKYLDLHECYEKYINLKGIEKVDYITYLAMFDQLYDIPKERKTGEYRKYLLYLIEYLTWFVQRIRPLMDLDSDLQEQVEQALVNWDNGMVPGWPKETGSALANVGAHLDLSAFSSWEELASLGLDRLKSALMALGLKCGGTLEERAQRLFSTKGKGSLDPSLMTKNSKNRITKEKEALRQRELATLEAQIYRLADLVSAQRAATKENVQRKQARTDGERDDSENEESEEESPDEGDDDVPYNPKNLPLGWDGKPIPYWLYKLHGLNISYNLRYVVTTFIKAPRLFKGILLSGGTRMGCGVWVYRIRLISLMSLRSRMLWPCGRS

SEQ ID NO: 11561 - protein, 212 aa, Phyllotreta nemorum; identical to SEQ ID NO: 11446

SEQ ID NO: 11562 - protein, 390 aa, Phyllotreta nemorum
MLEDIEIVCIAYAIHKRKKKQRSCCVHPLNTQRLNLGQFHCLFGELRKYPERFFNYYRMSITSFDELVLFLRPRLQKNNTRFCKVISVEERLTITLRYLATGTNFAAMQHSFVMGRTTIAEIVKDTCTALWITLQPIEMPEPTTERWLQYANEFWSRSNFPNCIGAVDGKHIRLMSPQHSGSQYFNYKKYFSLMLMAIADANYCFIAVDIGAYGREADCNVFKQSTLGVKMYNNTLNLPPPRGLPGTNEPCQPFVFVGDEAFGLHTNLLRPYSRRNLDEKTRIFNYRLTRARRFVECTFGILSNKWRVFHTPILVQPDFAVKIVQAACVLHNFVRRRDGYQFEDTLSCNLEDIQVRGTGGRRTEGHCVRDNFADYLVSPEGAIPWQQRMI

SEQ ID NO: 11563 - protein, 146 aa, Phyllotreta nemorum
KQYNEDEPEDNPESPEEFGESSDMMAGYDHEETDIIISDPTTSVPEDSISTKEDFEELIDEGSRKNNISKQEVTAKHIQDFHRYTELFDYGKPDAVKKPGGKKFQPKVSLVGGVALPSKPNAEKIIITQNSNVLNTSQASKVTSII

SEQ ID NO: 11564 - protein, 492 aa, Phyllotreta cruciferae
MKKEAKERRRKEKMGWDNEYLHYTNSDNPFGDGNLLTTFVWNKKLSKEGIKNVGHEEIEAINRLKQEENKRELEKVKKRRLERELERQKRDEETQMMQRSKEAAQFEEWERQEDKFHLEQARLRSHIRIQDGRAKPIDLLAKYISAEEEVDAVEMHEPYTYLNGLQIKDLEDLVEDIKVYKELERGKNLDYWNDITVIVEDELQKLRKIEKQNDFDLGLNRREGIHQSVATDVTSVFKGKTAAQLAALEKQIGSKISSKADGIDIGYWESLLSQLKAHMARARLRDRHQDSLRRKLQVLKAEQAITGVGQSHSETHSTDNEETTSEPKPSTSQDTLETMEESNEKTEDAAHEWLNECFSAYQAGGYSPKFLTPDDTEPGTIVVSEEDDVNRLEFARMQVLGQGTKIENVITKEELLLQKEARKGMDGDEAQFSVEQALDNPVYLWSDKYRPRKPRYFHRVHTGFLWIKCDQARSPIDNPPLVFRLVLEKNIF

SEQ ID NO: 11565 - protein, 421 aa, Phyllotreta cruciferae
MDNLEANIMDKSMRSVFVGNIPYEATEEKLKDIFGEVGQVLSFKLVFDRETGKPKGYGFCEYRDQETALSAMRNLNGYEIGGRNLRVDNACTEKSRMEMQNLLNQPPIENPYGEPIQAEKAPEAISKAVASLPPEQMFELMKQMKTTIQNNPTEARQMLLQNPQLAYALLQAQVVMKIIDPHTAASLLHPVNQVPATLLPGDKNVAVQVPINNQYREPPAPVQPPRQEYQPVPPPLVHPNHVQQPVFTGQDVDLRSMGNVTDPRIRPMIVDQDMRQMPAVIQNPLPPTISESFSRDPRSGTSFPSDPRQARMDPRQKNIVPPTSQQVPPTVNPKIMPPQAGPVVRPAQNVIAQSAAAASVSAATANVSPGIGGAGATDQEKAALIMQVLQLSDEQIAMLPPEQRNSILVLKEQIAKSAHVR

SEQ ID NO: 11566 - protein, 392 aa, Phyllotreta cruciferae
MAQMDAEREKSLQEYRKKLLEHKEVESRLKEMREQLKDLTKQYDKSENDLKALQSMGQIVGEVLKQLTEEKFIVKATNGPRYVVGCRRQLDKAKLKAGTRVALDMTTLTIMRYLPREVDPLVYNMSHEDPGDVTYSAIGGLSEQIRELREVIELPLMNPELFMRVGITPPKGCLLYGPPGTGKTLLARAVASQLDANFLKVVSSAIVDKYIGESARLIREMFNYAKDHQPCIIFMDEIDAIGGRRFSEGTSADREIQRTLMELLNQMDGFDSLGQVKMIMATNRPDTLDPALLRPGRLDRKIEIPLPNEQARLEILKIHALPIAKHGEIDYEAIVKLSDTFNGADLRNVCTEAGLFAIRAEREYVIQEDFMKAVRKVADNKKLESKLDYKPV

SEQ ID NO: 11567 - protein, 259 aa, Phyllotreta cruciferae
MARRYDTRTTIFSPEGRLYQVEYAMEAISHAGTCLGILANDGILLAAERRNTNKLLDEVFISEKIYKLNDDMVCSVAGITSDANVLTNELRLIGQRYLYQYGESIPCEQLVSWLCDVKQAYTQYGGKRPFGVSILYMGWDKHYGYQLYQSDPSGNYSGWKATCIGNNSSAAISSLKQEYKEGDMTLKDAKGLAVKVLAKTLDMAKLTSEKVEMATLTRRNDKTMINILNSKEVEELISEYEKSEAAAEATKKQEQKSAA

SEQ ID NO: 11568 - protein, 849 aa, Phyllotreta cruciferae
MSESTKAEPIKVESKTTDDKNKNELSDEDKQLQEELNLCVEKLQENDSKLYMPALQALGNHIRASTTSMTSVPKPLKFMKPHYDTMKQIFEKITEPSVKSLCADIISVLAMTMGEGRDCLKYRLVSDLDKIGEWGHEYVRHLAGEIAGEWAETDFLVNTEIRDKLILLTKQIVPYNMAHNAEAEACDLLMEIERLDLLEQYVDENIYPRVCLYLTSCVPYVADPENTTLLQTALMLFRKFKQYPQALRLAMQLNDHSLIEEIFLNCPDTDVQKQLAFMLGRQQIYIEVPDSTPEYEDLIEIMANCHLNNHFLNLARELDIMDPKTPEDVYKSHLENSRPPFGGSQVDSARQNLAASFVNGFVNAAFGQDKLLMEDGNKWLYKNKEHGMLSATASLGLVLLWDVDGGLTPIDKYLYSSEDHIKSGALLACGIVNCGVRNECDPALALLSDYVLHSTNIMRIGAIVGLGLAYVGSNREAVLSLLTPVFSDPKSNMEVIGMSALACGMIAVGSGNLQVTTTIMQTLMEKSETELKDTYARFLPLGLGLCMLGKQEGIDSIIAALEVIPEPFKSMATTMVDICAYAGTGNVLKVQHLLHICSEHYDGSDSSDKSSKDKDKKDATEKEKDLSSRQAVAVLGIALISMGEDIGSEMAFRTFGHLLRYCEPVIRRAVPLALGLISVSNPKLSILDTLSKFSHDSDAEVAHNAIFAMGLVGAGTNNARLAAMLRQLAQYHAKDPNNLFMVRIAQGLTHLGKGTLTLSPYHSDRQLMSPVAVAGLMATLVGFLDVKNIILGRSHYLLYTLAAAMQPRMLVTFDEDLNPLPVPVRVGLVSLIIESLNCNLVKKMFYFRL

SEQ ID NO: 11569 - protein, 506 aa, Phyllotreta cruciferae
MTDSNMDSKEEKQASPENAQLKPEATEPEAPPAQASPAAGVIRRNFITPAGTIVETNEEQPPEPTTEEVVKTTSSNPSPAEQKPESEIVTYAAEVLPQEQREQFAEAKSYAVEMPAENFPNNNFTQDISYVNIEGTVVPVTISEMEHPGDYANLQTAQYNNGYTDGTQYLTNHQYQNMYIERTTVDNSPSATVLYRDDPNLGASRFQGNYDISSSQSQVNLLPSAPGETYYTSTPNWTPTSSGTYQQQYPSGTINVLQADSTQAFGSPYINATWSSNSMEDGRPSSQEVLVKECVNCGASVTPLWRRDGTGHYLCNACGLYHKINGVHRPPTKPTKKPQATGNRRNGVTCANCKTNNTTLWRRNNQGEPVCNACGLYYKLHNVNRPISMKKEGIQTRKRRPKNSSVGNPASAAGQVRLGIPSYPSYSEMDVQQDQYQLPMNVYSQRPQVSYRQYGTENLGTLNAQPLQPIITHEDEQASVITSTSQQARFRTKVEEDEGSNPSMQS

SEQ ID NO: 11570 - protein, 1621 aa, Phyllotreta cruciferae
MALPGNGIFVVKGEISNLMAAMKRGPKWSSHSYQDDDVDALLRNFHELRDILHNVNDLGYVEPNTFLAPFLNVIRSEETTGPVTSLALSAVNKFLSYGLLDPVQTSIPQTIHTIADAVTHARFVGTDQSSDGVVLMRILQVLRTLTLSPEGATLTNESLCEIMLSCFRICFETRLSELLRKTAEHYLKDMVQLIFMRLPQFSEDPKLSYVKRLRMQPGDLEQTRTKRKKYSKKEHKEVAKAPAQEVNVESTPQTDIVDMQGTILRNNEVTTPSSPNLVDTDVAIDIPTDDSMKTSETSTSNLEDSAEKETDEPFQDYVNQRGIRFTPQFQQETNLSPYGLACVRELFRFLISLCNPLDKQNTDIMIHLGLSLLTVAFEISADNIGKYSTLLTLVEDDLCRNLFALMNTDRLTIFAANLQVSFLLFESLRAHLKYQLECYLKKLMEILRSESNKVSYEHKEIALDNLLQLWRVPGFHAELYVNYDCDMYCTNLYEELTELLAERSISTIVGVYHAHLLSLDGLLIIIDGIGKRFDEAKDRTDTDEISSYIGENTRIKGCVKVPDKKVLAAKKGIKKWLPQGTEYFNQKPKKGIQFLQEHGVLKQELDVEEIARFLRENPALNKAMIGEYISNRGNLKILEAFVSTFDFTGIRIDEALRAFLETFRLPGEAPTISLILEHFAEHWHKSNGEPFADVDSAFTLAYAVIMLNVDQHNENAKKQTIPMSPNAFKKNLKGVNGGDDFEEDMLDEIYTSIKSEEIVMPAERTGVVRDNYLWKVLLRKGRSPEGGVYMRDDGGAYDADLFRIAYGPLAAALNSVYERADHEGVQKKVMRGFERCASIASNLGMTANLDMLLVSLSKFTVFHNHQKQTAVVVQFGSNGKAQLALKTLFMLIHQHGNSTREGWKHLFDLLLALYSNDLLSKSFVEVEDFVEPSGKLCLVYKDAPSAAKQDTGLLSSLYSYMISVENLSKIPSPEEQSLIDKARECIKECNLEQMITDSKFLHQQALFQLVDTLIELSRGPDVQDGSSYDYNENVTVFFLELLVKIVIQNRDRVMTIWDRVRDHVYTLVMNSSLMDYQFLLERSVVGLLRIAVRLMRNEEMSHVVLQSLRMLLFLLKGGVLAGISRQMAFGLYEMLKTSAQNIHTTADWTVVFALLECVGAGAKPPRPVLTVEENDAKPKPDEEHPQTKDHKKDEEGASAFSDPKTNETPKNPTQRPQSPGTALTSPVGTPNTGGWIIVSDEDDLQPHRGPQHTLPVHYHLRLDADLSPHDPLSMLKCCESLAFLVRDVAHITPYNFDVCVRCVRTFVEAALKPPPNNHPNTRRSNLKKTRKKSPAGSQEEDSSGGDEDEDLPSGYHQVPIQLLDLMHTLHTRTAQIFKWWAEEGGEISGETSLWTQGWCPLLQGIARSCCDTRRTVRTSAIAYLQRALLVHDLQTLTPKEWEQCFRRVLFPLMNYLLQTTGPRDAVSTEETRIRAAGVLSKVFLHHLAPLSSLQGFADLWSTVLELMDGYMHADGSELLLEAVPESLKNMLLVMEAAGVFDGPDGKKNALWAATWERIGKFLPGLKDELFREMGSRRKVVEEAKDVEEAFPKEKEAECWEKNVGGREQDVDGREKEELVAC

SEQ ID NO: 11571 - protein, 205 aa, Phyllotreta cruciferae
MSILAYNGGAMVAMRGDNCVAIAADRRFGIQAQTVATDFEKVFEMGPHLFVGLPGLATDTQTVMEKLRFRKNLYELKENRRISPKVFAAMISNMLYEKRFGPFFVEPVVAGLAPDTFEPYICNMDLIGCINEPSDFVVGGTASAQLYGMCESLWEPNLAPDDLFETISQALINAFDRDAISGWGATVYIVEKDKVTVRNLKTRMD

SEQ ID NO: 11572 - protein, 965 aa, Phyllotreta cruciferae
MEGKPELEVVKSAVSTLYNNPDGGEKERASRWLLELQKSVHAWTVADELLRRCTNADDLQTRYFAAQTMRTKIHQSFHELPREVHESLRDSLLEHMGACAGVDEGAGAAIVTQLSLALADLALQMPDWRTPALDLIGRFSAGSNVWPLLEVLTVLPEELESRSVRLGENRRYEVLEDMKFCAPTVNEFLKHCSNLYGRGGSERLAAGDRQIDVKILRCFASWISVGAIGPSQLSEDRVVVDMAFDVLKAGVRGDEKETLTGQLHEAATDCICTLLLRLEDNNNHVALETHLFENIVNLEVAYHASVALEDQAKSTDYCRLFTELAESFLGKIVDDGGGGGGDGGGAKRRTVYAVKCLDLVLMCVGHHDYEVAEITFNLWHMLSEELYQKNNKELTELFKPYVERLITALCRHCQMEPDMEGLLEKGDEFKDFRMKVSDLIKDVVFIVGSSSCFRQMFINLQTSGVTWDASEAALFVMQAVAKNVLPTENEVVPKVVEAILNIPNSAHVAVKYTSVLLLGELAEWIEKHPDALDPVLNFLVCCLRSGAEGGGVATAAAAALQNVCTCCGAHMGRHVPILLQLLQQSDSFGIGNTAVVGLLKGVASVVSCGMGGGAETASAVRELCSMQLSPLCSLMENDVRPVKGTLTDPVLWLDRLSSVLRYVNVNIVEGEIHPCKPVILEIWPILSRAFDTYHSDVRIMERCCRSVRFMLRCVARQLQDLLPSLVGQIVHIYCLYGHSCCLYVGSILVDEYAGDASCVQGLLDMLNAFLEPTFRLLQEENGLKNHPDTVDDFFRLCARFVQRAPKAFLSGGAHLAPIMQCALLAATLDHKEANVSVMKFFYDLINQGLSGRGEPDFDERKALVRSLLNEYGQQLVSNLIHSCVFYLHSYMLSEVGDVFVQLLDFDRQITSEWLANGLELLPKQQNGGIMAAKPKQLNDVHASITRSNSSKSVTHALKDLTRLYR

SEQ ID NO: 11573 - protein, 502 aa, Phyllotreta cruciferae
MAQRLPGPVSNQVPGGPPPPQRYQQQPPNQGMRQYGQQSFPPRPGYNPPPPNMQSSGGTMIQRPPGAPYSPMRGGPMPPQPVGKRPSDNRNPLQQKNSDYSHGTSKKKKKLADKILPQKVRDLVPESQAYMDLLAFERKLDSTIMRKRLDIQEALKRPMKQKRKLRIFISNTFYPAKEPQPEGPDGPCQEGTVASWELRVEGRLLEDSKNDPNKVKRKFSSFFKSLVIELDKELYGPDNHLVEWHRTLTTQETDGFQVKRPGDKNVRCTILLLLDYQPLQFKLDPRLARLLGVHTQTRPVIISALWQYIKTHRLQDGHEREYIICDKYLEQIFNCTRMKFAEIPQRLNPLLHPPDPIVINHVISVEGGAESKQTACYDIDVEVDDTLKTQMNNFLLSTASQQEIQGLDAKIHETVDTINQLKTNREFFLSFAKDPQQFIHKWIVSQTRDLKSMTDVVGNPEEERRSDFFYQPWAQEAVCRYFYTKVQQKRAELEQALGIRNN

SEQ ID NO: 11574 - protein, 138 aa, Phyllotreta cruciferae
MPKVRRSKKPPPEGWELIEPTLDELEQKMREAETESHEGKRKNESLWPIFKIHHQKSRYIFDLFYRRKAISRELYEYCLLENIADKNLIAKWKKQGYESLCCLRCIQARDTNFGTNCICRVPKSKLEEGRIVECVHCG

SEQ ID NO: 11575 - protein, 294 aa, Phyllotreta cruciferae
MPAATLGSISHPNNEDCGIRDVWAHNLEDEFRTIRQIVQKYQYVAMDTEFPGVVARPIGEFRSSADYQYQMLRCNVDLLRIIQLGLTFLDDNGKTPGGVYTTWQFNFKFNLQEDMYAQDSIDLLQNSGIQFKKHEDEGIEPLEFAELLMSSGIVLMENIKWLSFHSGYDFGYLIKLLTDNNLPQDETEFFDLLKLYFPTIYDVKYLMKSCKNLKGGLQEVAEQLELERIGPQHQAGSDSLLTGMAFFKMKEMFFEDTIDDSKFSGHLYGLGTSFTVNGTTNNYGNDNGDTTNSS

SEQ ID NO: 11576 - protein, 403 aa, Phyllotreta cruciferae
MAEAQKRGASVFEDLSNVEFETSENLDVIEKFKDMKLKEELLRGIFAYGFEKPSAIQQRAIIPVMKGRDVIAQAQSGTGKTATFSIAILQALDLTMRETQVLCLSPTRELAVQIQKVILALGDFMNVQCHACIGGTNLGEDIRKLDYGQHVVSGTPGRVYDMIRRRALRTRSVRMLVLDEADEMLNKGFKEQIYDVYRFLPPSTQVVLISATLPHEILEITSKFMTDPIRILVKRDELTLEGIKQFFVAVEREEWKFDTLCDLYDTLTITQAVIFCNTKRKVDWLTEKMRENNFTVSSMHGDMPQKERDNIMKEFRSGQSRVLITTDVWARGIDVQQVSLVINYDLPNNRELYIHRIGRSGRFGRKGVAINFVKSDDIRILRDIEQYYSTQIDEMPMNVADLI

SEQ ID NO: 11577 - protein, 532 aa, Phyllotreta cruciferae
MTAPAAGGDARGRTLAYKDKSKPADVRTSNINAAKAVCDAIRTSLGPRGMDKMIQAGNGEVTITNDGATILKQINVIHPAAKMLVELSRAQDIEAGDGTTSVVVIAGALLDAAEKLLQRGIHPTAISESFQRAAHLAVEILQEISTPVEITNRELLIKSASTSLNSKVVSQQSSLLGPLAVDAVLKIVEPGQEQACNLLDVKVIKQLGGTVEDTELIEGIVFSQKSANVSGPKRIEKAKIGLIQFCISPPKTDMDHNVIVSDYAAMDRVLKEERAYILNIVKQIKKAGCNVLLVQKSILRDAVSDLALHFLDKIKCMVVKDIEREDIEFVCKSLGCRPIASLDHFTAENLVTADLVEEVGVGGNRMVKITGIQNAGRTVTLLVRGSNKLVLEEAERSLHDALCVIRCLVRKKALIAGGGAPEIEVALKLAAMANKLEGIDAICTRAYATALEIIPFTLAENAGLNPIQTVTELRNRHAKGETSAGINVRKGTITDILEENVVQPLLVSTSALSFATETVRSILKIDDIVSIF

SEQ ID NO: 11578 - protein, 358 aa, Phyllotreta cruciferae
MEAMDIVIPEKEEGSPSEVKQVLQDLDMEDLYTKYKKLQQTLEFLEVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVQYSDIGGMDMQKQEIREAVELPLTHFELYKQIGIDPPRGVLMYGPPGCGKTMLAKAVAHHTTAAFIRVVGSEFVQKYLGEGPRMVRDVFRLAKENSPAIIFIDEIDAIATKRFDAQTGADREVQRILLELLNQMDGFDQTTNVKVIMATNRADTLDPALLRPGRLDRKIEFPLPDRRQKRLIFSTITSKMNLSEEVDLEDYVARP

SEQ ID NO: 11579 - protein, 162 aa, Phyllotreta cruciferae; identical to SEQ ID NO: 11350

SEQ ID NO: 11580 - protein, 309 aa, Phyllotreta cruciferae; identical to SEQ ID NO: 11464

SEQ ID NO: 11581 - protein, 305 aa, Phyllotreta cruciferae
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGQ

SEQ ID NO: 11582 - protein, 540 aa, Phyllotreta cruciferae
MMQPQILLLKEGTDSSQGKPQLISNINACQSIVDAIRTTLGPRGMDKLIVSNRGSATISNDGATILNLLDVVHPAAKTLVDIAKSQDAEVGDGTTSVVLLAGEFLKQLKSYIEEGVHPRIIIRAVRKATQICLEKINALAVKIDKSNAEEYRSLLDKCAATAMSSKLINKQKSFFSKMVVDAVLLLDELLPLNMIGIKKVQGGGLEESMLVAGVAFKKTFSYAGFEMQPKIYKDCKIALLNIELELKAERDNAEIRLSSVKEYQKVVDAEWNILYNKLEKIYESGANVVLSKLPIGDVATQYFADRDMFCAGRVQEEDMKRTLKACGGSVMTTANDLKDEVLGKCQLFEEKQIGGERYNFFKGCPNAKTCTIILRGGAEQFLEETERSLHDAIMIVRRTIKNDSIVAGGGAIEMELSKLLRDYSRTIAGKEQLLIGAIAKALEIIPRQLCDNAGFDATNILNKLRQKHAQGNSWYGVDVNMEDIADNYETCVWEPAIIKINALTAAAEATCLILSVDETIKNQKSEAPPQMGGRGMGRPM

SEQ ID NO: 11583 - protein, 890 aa, Phyllotreta cruciferae
MSRQGPSKRYDSDSDSDSVDSAEEARKRDLQERDEFANRLKKRDEDRTRNVVQNFDKRTYEEAAKRLKLDNAGRDKVISELRKTSRWKYLEKRKDDKLQELEADIVDDEYLFEEEILTEREKKERQHKKELLQLAQEHEKARELERIQRYHMPRDLGKDSTADYIEVDELEKVPQSEQKKWEKDQMASAVFKFGAKDVKKTDDYELLLEDQIDFIQALQMPGSSEKKVPELSDVQKKKLTIEETKKSLPIYPFRDDLIQAVKEYQVLIIKGETGSGKTTQIPQYLHEAGFTADGKKIGCTQPRRVAAMSVAARVAQEMDVKLGNEVGYAIRFEDCTSERTVIKYMTDGTLHREFLSEPDLQSYSVMIIDEAHERTLHTDILFGLVKDIARFRPDLKLLISSATLDVTKFSEFFDDAPVYQIPGRRFPVDIYYTKAPEADYVDACVVSILQIHVTQPLGDILVFLTGQDEIETCHELLQDRVRRLGSKVKELIILPLYANLPSDLQAKIFEPTPPGARKVILATNIAETSLTIDNIIYVIDPGFAKQNHFNSRTGMESLMVVPISKASANQRAGRAGRVAAGKCFRLYTAWSYKHELEETTVPEIQRINLGNAVLMLKALGINDLVHFDFLDPPPHETLVLALEQLYALGALNHHGELTKLGRRMAELPVDPMMAKMILASEKYKCSEEIVTIGAMLSVNGAIFYRPKDKIIHADTARKNFNHLAGDHLSLLNVYNQWRDSDYSLQWCYENFIQHRSMKRARDVREQLVNLMTRVEIEIVSGIDETDNVRKAITSGYFYHIARFSKGGSYKTVKHNQSVTIHPNSALFETLPRWVLYHELVFTTKEFMRQVIEIESKWLLEVAPHYYKAKELEDSTNKKMPKTVGRSKMTD

SEQ ID NO: 11584 - protein, 456 aa, Phyllotreta cruciferae
MKVEEVKSTVKTQRISAHTHIKGLGLDEAGFAIPSAAGLVGQEQAREAAGVVVDMIKSKKMAGRAVLLAGPPGTGKTAIALAIAQELGNKVPFCPMVGSEVYSTEIKKTEVLMENFRRAIGLRIRETKEVYEGEVSELTPVETENPAGGYGKTVSHVVIGLRTAKGSKQLKLDPSIYEALQKEKVEVGDVIYIEATSGAVKRQGRSDAYATEFDLEAEEYVPLPKGDVHKKKEVVQDVTLHDLDAANAKPQGGQDVLSMMGQLLKPKKTEITDKLRKEINKIVDKYIDQGIAELVPGVLFIDEVHMLDIETFTYLHRALESAIAPIVIFATNRGRCLIRGTDDVFSPHGIPLDLLDRLLIIRTIPYNKSEMEQIIKLRAVTEGLEIEPEAISSLGEVGTKATLRYAVQLLTPSFLTAKINGRSNILQSDVEEIGCLFLDAKSSAKILTEHKDKFMT

SEQ ID NO: 11585 - protein, 658 aa, Phyllotreta cruciferae
MTSIIKVQALSGAKDESPPCYLLQVDDVRILLDCGWDEKFDMEFIKELKRHVHTIDAVLISYPDNYHLGALPYAVGKLGLNCPIYATIPVYKMGQMFMYDLYQSQYNMKEFCIFSLDDVDATFEKVIQLKYNQTVPLKGKGYGITVTPLPAGHMIGGTIWKVNKVGEEDIVYCNDFNHKKERHLNGCELKKLQRPSLLITDAFNATYQQARRRARDEKLMTNILQTLRNHGNVLIAVDTAGRVLELAHMLDQLWRNKESGLLAYSLAFLNNVSYNVVEFAKSQIEWMSDNLMRSFEGARNNPFQFKYLQLCHSLGELSKVPSPKVVLASSPDLESGFSRELFLQWCSNPNNSIILTTRTSPGTLARDLIDNGGGRTIDLIVERRVKLEGQELDDYERRQRSKYDKLEEDEADSDSDSDIEMSVTSKGKHDIVIKQEGKISTGFFKVTKKMYPMYPFKEDKIKSDEYGEIVKAEDYKLAEISAEGEDNKENIVIKKEEEEITEITEQPTKCIILQRTVQVSCQVQYIDFEGRSDGESLMKILTQLKPRRVIVVHGTEENTSVIEKHCLDNLEARVFTPSRGEIIDATSETHIYQVRLTDALVSQLSFQKAKEAEVAWLGAHIVLRESQADAKRMNLDNEEMEGNSCSFYQQLFLQLSKV

SEQ ID NO: 11586 - protein, 757 aa, Phyllotreta cruciferae
MPPLEVTANTNNEESAPINPVVGIIYPPPEVRNIVDKTASFVARNGPEFEARIRQNELGNPKFNFLNGGDPYHAYYQHKVKDFREGKGQEPTPGLSQAVAKLSVSASAQQKQQEILKQVEQPFVPKDPPSEFEFIADPPSISALDLDIVKLTAQFVARNGRAFLTQLMNREQRNFQFDFLRPQHSLFQYFTKLLEQYTKVLIPPKSMEQRLRDEAKSAKAVLEQVKYRAEWLRYQEQQKAKEEEILERERVAYAQIDWHDFVVVETVDYQPFEIGNFPPPTTPEEVGARILIQERIEEGEDIEMQLESDEDDDTNADDGLSSMQDKTKRKGGDDNRLQDMEEDTSDEDNDDDSGKTGAASSLIQPPLPPIPDKVLVKKYDPKQAVKVSRPTVGDDYLVSPITGEKIPASKVQEHMRIGLLDPRWVEQRDKQMSDKMNQDTVYAAGSAIDASLKLLAERRTDIFGVGDEETAIGKKIGEEDVRKDEKVTWDGHTSSVEAATRAARANITLEEQIHQIHKVKGLLPDEEKEKIGPKNIGSKKINIQSVITTKPANQATQQPKPPVSIIQTSAQPIMPVPTQPTMLAPQPSIMMMPAPPMPTIRPPPLMMPGGVAMGGYPVGPMPPGPGMNMAPMKHPNEGPSEEEPSNKKLRNEDSLVPENVFLSRNPSQVSIKISIPVMPEKSEWRLKGQMVSWTLALTESVSNLKAKIQEETNMPPAKQKLFFDGMFFKDSNTLAYYNVTQGAVIQLQIKERGGRKK

SEQ ID NO: 11587 - protein, 335 aa, Phyllotreta cruciferae
  misc_feature (324)..(324): Xaa can be any naturally occurring amino acid
MPSTEVTTTKVIVHPLVLLSVVDHFNRMGKIGNQKRVVGVLLGCWRAKGVLDVSNSFAVPFDEDDKDKSVWFLDHDYLENMYGMFKKVNARERVVGWYHTGPKLHQNDIAINELIRRYCPNSVLVIIDAKPKDLGLPTEAYQAVEEVHDDGSPTSKTFEHVPSEIGAEEAEEVGVEHLLRDIKDTTVGTLSQRITNQLLGLKGLHLQLRDIRDYLMQVCDNKLPINHQIIYQLQDIFNLLPDINQDAFNNSFYVKNNDQMLVVYLGALVRSIVALHNLINNKLTNRDAEEGKKEEKKDNKDKDSKDKDKEKTDKEKEAKKDEKXKKDNKDKDSKD

SEQ ID NO: 11588 - protein, 550 aa, Phyllotreta cruciferae
MFGGGRAPILVLSQNTKRESGRKVQLENINAGKQIADVIRTCLGPQAMLKMLMDPMGGIVMTNDGNAILREITVQHPAAKSMIEIARTQDEEVGDGTTSVIVLAGEMLAAAEQFLEQQIHPTIIIRQYRQALEDMVQFLEGPLSVPLDRNDKNAVAQVVKGCIGTKFLSKWSDLAVNIALDAVNTVLLEENGRTEVDIKRYAKVEKIPGGSVEESRILRGVMLNKDVTHPKMKRHIKNPRIILLDCALEYKKGESQTNVEISTETDFTKLLELEEEHVKRQCDEIIALKPDVVFTEKGVSDIAQHFLLKAGITAIRRVRKSDNNRIARACGAVIVNRTEELQESDVGTGAGVFEIKKFGDEYFCFIDECKNPKACTILLRGASKDILNEIERNLQDALQVARNIVLSPRLVPGGGAIEMAVAQRLMQKATHGPYRALAHALEIIPRTLAQNCGANTIRTLTALRAKHANHTDTEKPCTWGIDGESGELVDMKIKGLWEPLSVKLQTYKTAVETAILLLRIDDIVSGSKKKGDKEVPTPSQMQQQEAQGGD

SEQ ID NO: 11589 - protein, 233 aa, Phyllotreta cruciferae
MMQTGVRPYYPDYSTIPVERQINPYADNGGSVVAIAGKDFVVIGADTRLSSGFSIYTRNQNKLFPLSETTVLGCSGCWCDTLTLTRIIKSRMQMYYQEHNKNMSTTAAAQMLSTMLYYKRFFPYYISNILVGLDNEGKGCVYSYDPVGHCEKATYRAGGSAGALLQPLLDNQIGQKNLQKPSQEDLTQEKAISTLKDVFISAAERDIYTGDSVLIKIITKDGMKEETFDLRKD

SEQ ID NO: 11590 - protein, 299 aa, Phyllotreta cruciferae
MFQFGFNMFPDIPRPFNMTYKCYSVAMFPGNERQDVERGGKIIMPPSALEQLTRLNINYPMLFKLVNKKTNRTTHCGVLEFVADEGKVYLPLWMMHNLVLTEGDLVQMESVSLPVGTFSKFQPLNPDFLDITNPKAVLENCLRSFACLTNGDVIAVRYNQKAYELCVLETKPGNAISIIECDMNVEFAAPVGYKEPEHAKKEEEMSVDPADLMPEPSGFVAFRGAGNRLDGKKRKDSSSNDTPSVKPAYVRGIPDYDYQIGTLDFIRRTIAKPKEKENSEDGDDFKAFSGTGFSLRNRN

SEQ ID NO: 11591 - protein, 540 aa, Phyllotreta cruciferae
MSALPGAIAFDEYGRPFIILRDQDKQKRLTGIDALKSHILAASQIAHTVRTSLGPKGLDKMMVSSDGEVTVTNDGATILKMMDVEHEVAKLLVQLSQSQDDEIGDGTTGVVVLAGALLEQAGALLDRGIHPIRIADGFELACQTAVDHLEKIAELFPISAENTEPLVKVAMTTLGSKIINKCHRQMAEIAVNGVLAVADLQQKDVNFELIKVEGKVGGKLEDTTLVKGVVIDKTMSHPQMPKELKNVKLAILTCPFEPPKPKTKHKLDVTSVDDYKELRLYEQEKFKEIVGLVKKAGATLAICQWGFDDEANHLLLQQELPAIRWVGGPEIELIAIATGGRIVPRFEELSPEKLGSAGLVREISFGTTKDKMMVIEECSNSRAVTILVRGGNQMLVDEAKRSLHDALCVVRSLIQEPRVVYGGGAAEIACSLAVAAQADQLASLEQYAYRAFAEALESIPLALAENSGFSAIHTLGEIKAKQAASGDPALGVDCMNIGNINMREQHVTESLRSKRQQLLLATQLVKMILKIDDVRQPGSG

SEQ ID NO: 11592 - protein, 113 aa, Phyllotreta cruciferae; identical to SEQ ID NO: 11364

SEQ ID NO: 11593 - protein, 534 aa, Phyllotreta cruciferae
MVSLNPVRILKHDAEDERAEIARLSSFVGAIAIGDLVRSTLGPKGMDKILVSSGRNSGMVEVTNDGATILKSVGVDNPAAKILVNMSKVQDDEVGDGTTSVTVLASELLKEAERLIEQKIHPQTIIAGWRKAVDIARKALLDASNDNSANLEAFREDLMNIARTTLSSKILSQHKEHFAKLAVDAVLRLKGSGDLQAIQLIKKTGGTLQESFLDEGFLLDKRPGVHQPKRVENAKILIANTPMDTDKIKVFGSHIKVDSMAKIAELESAEKDKMKDKVNKILKHNANVFINRQLIYNYPEQLFADAGVMAIEHADFDGIERLALVTGGEIVSTFDHPELVKLGTCDLIEQIMIGEDTLLRFSGVALGEACTIVIRGATQQIIDEADRSLHDALCVLAATVKESRIVFGGGCSETLMATAVARASINTAGKEALAMDAFARALLQLPTIIADNAGYDSAQLISELKAAHNSGLNTMGLNMEKGELGDMRALGITESFVVKRQVLISAGEAAEMILRVDNIIKAAPRQRTEDRGMC

SEQ ID NO: 11594 - protein, 279 aa, Phyllotreta cruciferae
MFRNQYDSDVTVWSPQGRLHQVEYAMEAVNLGSATVGLKSNSHAVIIALKRASSELSAYQKKIIQIDDHIGITISGLTADARILSRYMRNECLNYKYSLDAYMPLNRLINILGIKMQHCTQRYDRRPFGVGLLVAGCDDNGAHIYQTCPSANFYNCKAMSIGARSQSARTYLEKKLDELSSCSLEDLIKHGLRALRDTLPPEVDLNTKNVSIGYVGKGITFKILEEEETAPYLALIEGEERRGGAGGGGSSEGQADPLRESGDDGPKDPVPAVAMDTTE

SEQ ID NO: 11595 - protein, 849 aa, Phyllotreta cruciferae
MGLKPGNNQEPMEITFHDDDLPYEEEILRNPYSVKHWLRYIDHKKTAPNNEMNIIFERALKELPGSYKLWYNYLRTRRNQIKSKCITDPGFEEVNNAFERSLVFMHKMPRIWMDYCTFLTDQCKITRTRKVFDRALRALPVTQHNRIWPLYLMFVQKHDISETAVRVFRRYMKLCPENAEEYIDYLTKVERLDEAAIITAKIVNDDNFVSQQGKSKHQLWNELCELISKNPEKVRSLNVDAIIRGGLRRYTDQLGHLWNSLANYYVRSGLFERARDIYEEAIQTVTTVRDFTQVFDAYAQFEELSLSKRMEEVATKQNPSEDDDTELELRLARFEYLMERRLLLLNSVLLRQNPHNVQEWHKRVQLYEGKPHEIINTYTEAVQTVDPKLAVGKLHTLWVEFAKFYESNEQIEEARLIFEKASQVPYVKVDDLATVWCEWTEMEIRNENYDEALKLMQRATVMPSRKVAYHDDTETVQSRLYKSLKVWSMYADLEESFGSFKSCKAIYDRIIELKIATPQIIINYGVFLEENNYFEEAFRAYEKGISLFRWPNVYDIWNTYLTKFLKRYGGSKLERARDLFEQCLDGCPPQFAKHLYLLYAKLEEEHGMARHAMAVYERSTKAVPENEMFDIFNIYIKRAAEIYGIPKTRQIYERAIEVLPEDKTREMCLRFADMETKLGEIDRARAIYAHCSQICDPRVTAEFWQIWKEFEVRHGNEDTMREMLRIKRSVQAVYNTQVNMMSAQMLSSAGSSSGTIADLAPGVKDGMRLLEAKAAEMAGSVAQKPNIMFVRGETQGDKKDKVVNPDEIDIGSEDEEEEEEEEISVEKQNVPSEVFGSLKKKGTDEDEDD

SEQ ID NO: 11596 - protein, 371 aa, Phyllotreta cruciferae
MANGPIAERNRDATIYVGGLDDKVSESLLWELFVQAGPLVNVHMPKDRVTMMHQGYGFVEFMGEEDADYAIKIMNMIKLYGKPIRVNKASAHQKNLDVGANIFIGNLDPEVDEKLLYDTFSAFGVILQTPKIMRDPETGNSKGFAFINFASFEASDASIEAMNGQYLCNRPISVSYAFKKDSKGERHGSAAERLLAAQNPLSQADRPHQLFADAPPIGMMPMSMAPPPPPLITGMMPPPPPTPGGMPPPPPPVPPPSSFPAGIPPPPLPPSQPPLPPGAPPAMAPVPGSATRPPPPPPWSGAAANVPMPPGPPSSNAGGGFGGMLPPPPPPGGRPLPSNWRPPPPPPPNFGSARPPFPPRGPPPPPPTFEG

SEQ ID NO: 11597 - protein, 257 aa, Phyllotreta cruciferae; identical to SEQ ID NO: 11369

SEQ ID NO: 11598 - protein, 173 aa, Phyllotreta cruciferae
MKPMPMNYHRPSTPCQASEVEVEPKFVNVVEARRLRTLTAETAGELDVLALDGDTLGVDGAEVGVLEEGDEVGLDGLLKSTDGGGLEAEIGLEVLGNLTNKTLEGQLADEELSRLLVATDLTESDSTGLVAVRLLDTTGRRGGLASGLGGELLTGSLATSGLTGSLLGASHDD

SEQ ID NO: 11599 - protein, 530 aa, Phyllotreta cruciferae
MAISLLNPKAEVARAAQALAVNITAAKGISEVMKTNLGPKGTMKMLVSGAGDIKITKDGNVLLHEMQIQHPTASLIARASTAQDDMTGDGTTSTVLVIGELLKQADIYIAEGLHPRTLTEGFDKARAKALEVLEKLKVPIEVNKESLTDVCRTSLRTKLHQNLADLLTDVCVEAILAIKQSDKPVDLHMVELMEMQHKTETDTQLVKGIVMDHGARHPDMPKSLKNCYILTCNVSMEYEKSEVNSGFFYKTAEEREKLVLAERDFIEQRVKKVVELKKALCNGTNKSFVVINQKGIDPMSLDMLAKEGIVALRRAKRRNMERLALACGGIAVNSFDDLQESHLGYAGHVYEHVLGENKYTFVEDCKVPQSVTILIKGPNKHTLMQIKDAVRDGLRAINNAIDDKALIPGGGALEVAVNKELLAYKDEIKGKSRLGVAAYAEALLVIPKTLAVNSGFDAQDTIVKLQEEARLSTEPIGLDLTSGEPINPKDAGIYDNYVVKKQILNSCSIIASNLLLVDEIMRAGMSSLKG

SEQ ID NO: 11600 - protein, 1041 aa, Phyllotreta cruciferae
MSSAGIADSPIDPPAKKRKLDSKNCGPDMANNEASGSSNAGEIDEGLYSRQLYVLGHDAMRRMATSDVLVSGLGGLGVEIAKNVILGGVKSVTLHDDAVCTVRDLSSQFYLTEADVGKNRAEACCKHLSELNTYVPTRAYAGPLDEKIIQKYRVVVLTNSTRAEQLRIGEITHNNDVALIVADTKGLFAQVFCDFGKAFSVVDVNGEPPVSTMIADISNDTESVVTCIDDTRHGMEEGDYVTFSEILGMTELNNCKPIKIKVLGPYTFSIGDTTKFSKYVRGGIVTQVKMPKEVHFKSLKESLQNPEFVVTDFAKFDHPIQLHLAFSTLHKFVEKTGRLPKPWSKDDATEFIALAKSLAVNGSTDTEVNTDILNIFSKCCSGDLNPINATIGGIVAQEVMKACSGKFYPIYQWLYFDAIECLPQDKEEITEELAAPVDSRYDGQIAVFGKDFQKRLGELKYFIVGAGAIGCELLKNFAMMGLGTQGGQVTVTDMDLIEKSNLNRQFLFRPHNVQQPKSATAAKVIKKMNPDVNIVAHENRVGPETENVYNDEFFEVLDGVANALDNVDARIYMDRRCVYYRKPLLESGTLGTKGNTQVVVPFLSESYSSSQDPPEKSIPICTLKNFPNAIEHTLQWARDNFEGLFRQNAENASQYLRDPDFIERTVKLPGVQPLEVLESVKAAIIDERPKDYDDCLAWARLHWEDQYANQIKQLLFNFPPDQLTSTGQLFWSGPKRCPEPLVFDINEDLHVDYVIAAANLKAQVYGIPTNRNRCYAKQVVTSIEVPEFVPKSGVKIAVTDSQMAMNGNNVDLDRINQIKQELPSMQELSGLTLTPLEFEKDDDSNFHMDFIVAASNLRAANYKIPMADRHKSKLIAGKIIPAIATTTSVVAGLVCLELYKLARSIKSLTPFKNGFVNLALPFFGFSEPIAAPKMEYCGNQWTLWDRFEVQGEMTLAEFLEYFKEKHGLEITMLSQGVCMLYSFFMPKAKAQERLGLTMSEVVRRVSKKKIEPHVRALVFELCCNDADGEDVEVPYVKYNLY

SEQ ID NO: 11601 - protein, 449 aa, Phyllotreta cruciferae
MADADAADDLLDYEDEENPEQTANENNSTEVQKKGVKGTYVSIHSSGFRDFLLKPEILRAIADCGFEHPSEVQHECIPQAVIGMDILCQAKSGMGKTAVFVLATLQQLEPTENVVYVLVMCHTRELAFQISKEYERFSKYMSNIKVGVFFGGLPIQKDEEVLKNSCPHIVVGTPGRILALVRSKKLNLKHIKHFILDECDKMLELLDMRRDVQEIYRNTPHEKQVMMFSATLSKEIRPVCKKFMQDPMEVYVDDEAKLTLHGLQQHYVKLKENEKNKKLFELLDVLEFNQVVIFVKSVQRCVALAQLLTEQNFPAIGIHRGMEQKERLSRYEQFKDFQKRILVATNLFGRGMDIERVNIVFNYDMPEDSDTYLHRVARAGRFGTKGLAITFVSEEGDAKILNEVQDRFDVNITELPDEIDLSSYSKFIKFDYDLWKYYMFTVFVSVEGR

SEQ ID NO: 11602 - protein, 499 aa, Phyllotreta cruciferae
ALVFTSKQNMGVVETDVEMKNADSPTGLEAGDNKRDKDLNSFTEIREQAKQIEKGIINKENRFILRVLRCMPNTRRKLNGIVLRSLINQIYPVVERDVLLSFIEESAGELDNTQTKARPATKSPVAEIDTYINLLCLVHLIDTNKLAEAERCSQILMNKITSQNRRTLDLVAAKCYFYYSRVAELTDKLDSIRGFLHSRLRTATLRNDFEGQAVLINCLLRNYLHYSLYDQADKLVNKCVFPETASNNEWARFLYYLGRIKAARLEYSVAHKHLIQAMRKAPQNTAIGFRQTVQKLTVVVELLLGDIPERQIFRQASMRHSLAPYFQLTQAVRMGNLQRFGEVLENFGPQFRVDHTFTLILRLRHNVIKTAIRSIGLSYSRISPQDIAKKLGLDSAEDAEFIVAKAIRDGVIEATLDPQGGYMRSKESTDIYCTKEPQLAFHQRISFCLDLHNQSVKAMRYPPNAYGKELESAEERREREQQDLELAKEMAEDDDDSFP

SEQ ID NO: 11603 - protein, 560 aa, Phyllotreta cruciferae
MASSHQALPVSAILKSKSEVEDEPKKKSREDWRKAKELEEARKAGTAPAAVDEEGKDINPHIPQYISSAPWYYGTSGPTLKHQRPQDDKQKEYSDLNDWYKRGVDTSKIVTKYRKGACENCGALTHKKRDCMDRPRKVGAKFSGANIAPDEFIQKNLSLSFDGKRDRWSGYDPSEHKTVIEEFQKVEEAKRQLKSDKLNANEESEDEEKDEDKYVDEVDMPGTKVDSKQRITVRNLRIREDTAKYLRNLDPNSAYYDPKTRSMREDPNAGMDATYHGENFVRFSGDTTNHARAQLFAWEAHGKGVDVHLLAEPTKLELLKKEYEKKKDEVKSNIQGTVLEKYGGEEYLEAPPKSLLLAQTENYVEYSRSGKVIKGAEKEVIRSKYEEDVYINNHTSVWGSYWSGGHWGYRCCHSFIKNSYCLGESGKLVNAQPTAELVTNDEPKEEQSQEDDEKDTVEALEKESEESESSSSSEEEKSKAKSKKKLKKKMKKQKKKQKKKDKDKEVKTSSFMNDEDEEVVLDDRKRPYNSMFEAKKPTEEQMEEYYKKRRRDEDPMNQFM

SEQ ID NO: 11604 - protein, 208 aa, Phyllotreta cruciferae
MGISRDHWHKRRATGGKRKPLRKKRKFELGRPAANTKLGTRRIHYVRTRGGNLKYRALRLDTGNFSWGSEGTARQTRIIDVVYNASNNELVRTKTLVKNAIVVVDATPFRQWYENHYILPLGRKKGAKMTPEEEEIFNKKRSKKVQKKYETRQKTAKVEPAIEEQFHTGRLLACLASRPGQCGRADGYVLEGKELEFYMRKIKSKKAK

SEQ ID NO: 11605 - protein, 320 aa, Phyllotreta cruciferae
MDRLLRLGGGMPGLTQAPPPSDAPVVDTAEQVYISSLALLKMLKHGRAGVPMEVMGLMLGEFVDDYTVRVIDVFAMPQTGTGVSVEAVDPVFQAKMLDMLRQTGRPEMVVGWYHSHPGFGCWLSGGDINTQQSFEALSERAVAVVVDPIQSVKGKVVIDAFRLINPNMMVLGQEPRQTTSNLGHLQKPSVQALIHGLNRHYYSISINYRKNELEQKMLLNLHKKSWMDGLTLADYSENCSVNEKTVADMLELAKNYNKALEEEEKMTPEQLAIKNVGKQDPKRHLEEKVDILMNNNIVHCLGAMLDTLVFKYFKVYRTVF

SEQ ID NO: 11606 - protein, 419 aa, Phyllotreta cruciferae
MTVINKMEVDGPLKGEGFRSYYITKIEELQLIVAEKSQNLRRLQAQRNELNAKVRMLREELMLLQEQGSYVGEVVKPMDKKKVLVKVHPEGKFVVDIDKNIDINDVTPNCRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWKYVCQIYILLYLCYKK

SEQ ID NO: 11607 - protein, 212 aa, Phyllotreta cruciferae
MVKLYCISILYKDTTYATWLKSAFDLQSFSFFQRGSVQEFMSFFCKTIVERTIPSSRQSVKEGEYMCHVYVRHDNLAGVVISDHEYPSRVSHTLITKILDEFAGKIPAVNWPTLQERDVAFPQLNTYLAKYQNPKEADAMTKIQEDLDETKIILVRKMLIILRYLSKHNTIQAVLERGEKLDDLVNKSEGLSIQSKAFYKTARKTNSCCSFT

SEQ ID NO: 11608 - protein, 242 aa, Phyllotreta cruciferae; identical to SEQ ID NO: 11380

SEQ ID NO: 11609 - protein, 385 aa, Phyllotreta cruciferae
MTEYWLISAPGDKTCQQTWDTMNNLTSKQNNLSANYKFSIPDLKVGTLDQLVGLSDDLGKLDGFVEQVTRKVAQYLGEVLEDQRDKLQENLQANNTDLPSYLTRFQWDIAKYPIKQSLRNIADIISKQVGQIDADLKTKSSAYNNLKGSLQNLEKKQTGSLLTRNLADLVKKEHFILDSEYLQTLLVIVPKAQFNEWNATYEKITDMIVPRSSELIIQDHDYGLFTVSLFKKVVEEFKLHAREKKFIVRDFTYNEEELAAGKNEITKLVTDKKKQYGPLVRWLKVNFSECFCAWIHVKALRVFVESVLRYGLPVNFQAILIHPNKKQAKRLRDVLNQLYGHLDSSAALSGPNVDSVDIPGLGFGQSEYYPYVYYKINVDMIESKV

SEQ ID NO: 11610 - protein, 557 aa, Phyllotreta cruciferae
MSILASPLSVAGSRTTGASVRTQNVMAASTIANVVKSSLGPVGLDKMLVDDIGDVTVTNDGATILRLLEVEHPAARVLVELAQLQDEEVGDGTTSVVIIAAELLKNADELVKQKIHPTSIISGYRLACKEACRYIQDHLTIPVEELGKESIVNVAKTSMSSKIIGADADFFSQMVVDAATAVKVTDSKGNSMYPIKAVNVLKAHGKSARESFLVAGYALNCTVASQAMPKKIVNAKIACLDFSLQKAKMKMGVQVLITDPNQLEGVRARELDITKERIQKILATGVNVVLLSGGIDDVCLKYFVERGAMAVRRVKKADLKRIAKATGAAFVTSLSNMEGEETFDSNMVGEAAEVVQERISDDELIVIKGPKARTAASIILRGPNDFYCDEMERSVHDALSVVKRVLESKSVVAGGGSVEAALSIYLENFATTLSSREQLAIAEFARSLLVIPKTLAVNAAQDATDLVAKLRAYQNSSQTKKDHAHLKYVGLDLLEGTVRDNRKAGVLEPTMSKVKSLKFATEAAITILRIDDMIKLDAEQKGGKNYQDAMSSGELYD

SEQ ID NO: 11611 - protein, 255 aa, Phyllotreta cruciferae
MFNSSQLNPPPFWSNGPAPGAFYNFPGTEWKPVTNPITHTQSPVTTSTSIVSITYDKGVLIAGDLLASYGSLARYKNCPRVIEINPNIILGAGGDYADFQYVKSFIEQKIIDEDCLDDGLKMKPKSLYCWLTRIMYQRRSKLDPFWNNLVVGGIQDGVPFLGTVDKLGTAYTDKVICTGYGAHIALPVLRDALDKKPNLNLNEAKALIKKCMEVLFYRDARSYPKYQLGIIDVDEGVKIEGPIAVEENWNIAYMT

SEQ ID NO: 11612 - protein, 701 aa, Phyllotreta cruciferae
MEFSKEPNFELLTAKDFSPEKYVKKLSQNYVGGSELQNLRRKIQGLSEETSSNLKKNVYENYIQFIETAKEISHLESEMYQLSHLLSEQKALLNCLSATSILEDVQPVNIDRDNKVNEKDIEEENKQKIAAILEKVEGCQELLKVPGRIFLYEGDLLEIEPTENTALKIVHVYLFTDSFMITTRNSNSRGLMKYIYESIYDLSSLAVVNVRDLGNVKHAFKLLIFPDTRVFQCSSNSNKKEWLDKFDQAKKTRLAQEQQKRESISEKSPTRVSFESPSYNPFDEVEEETSALHPEWFVDIPEELDVCVAQRHFEDALSLLQKAKEYLNQASSASGDKRDTVFTDIQRKVEQRQNNLTEVLMKELEVNPDKSLQGGLRAARRAVRLLNQLGRETQSCTLFLKLCSSMLRTQCKRVKREGSTTTYIKHLSSVVFTNMCHMSDEFLRAFPDSPACASAYVVWASNELLQFTTHFIKQVFMPQTSLSTVTECIVLVRQQCERLYVYGLDLCYQLDGALRSSLMKALKDARDKLIDSIKLRVLDDKWIPINLHSKSALSRCVQEYSQMGLTNVGNYVSGDTWLQLTASTLSFTKMYLNLLNDCMKLKTTELMYTIDETLYNVFEAQVRHNENALRSELNQDQRNFLTKNAEFLLVSLMQVVQKQYEENVGYECPTLAKLQKEYIALQKGVTPASRSTKAKYSSEFI

SEQ ID NO: 11613 - protein, 1234 aa, Phyllotreta cruciferae
MNELEKLEYLSLVSKICTELENHLGMNDKDLAEYIIHLSEKNNTLESFKKVLLENGAEFSDSFISNLLRIIQHMKPKKSSNKEDTDKVEKEGLAFKFPGLAIPNEKQKPLNLEEFSKENENDEIDVVADMMKQLEADAPSQKQTKEKSRSPSIERKSRIRSRSRSKERRRSRSRSKDRRRSRSRSRDRRRSRSKDRHSRRDKRHRSRSNEDYKRRRRDNSYSRDRRERGRSKESERRDRNRSRDDRKRDRSRSRTRRRERSYEKKFKSEKDNPEFEDDPTPGKIYNGKVSNVVPFGCFVQLEGLKRRWEGLVHISQLRAEGRVTNVSEVVSRGSKVKVKVLTITGQKVSLSMKDVCQTTGKDLNPLSHATTEREDKDRNPDRPTNNSTSVLRLPVSIDEGEEDSRKRVTRISSPERWEIKQMISSGCIDKSELPEFDDETGLLPKDEDGEADIEIELVEDEPPFLQGHGRALHDLSPVRIVKNPDGSLAQAAMMQSALAKERREQKMLQREQEVDSQPSGKNKNWIDPLPEEESKSMARGIGLQSQDLPEWKKHVIGGKKSSFGKKTNLTIIEQRQSLPIYKLKEELRKAVTDNQILIVIGETGSGKTTQITQYLAEAGFTARGKIGCTQPRRVAAMSVAKRVAEEFGCRLGQEVGYTIRFEDCTSPETMIKYMTDGMLLRECLMDLDLKQYSVIMLDEAHERTIHTDVLFGLLKQAVMKRDELKLIVTSATLDAVKFSQYFFKAPIFTIPGRTFPVEVLYTKEPETDYLDASLITVMQIHLREPPGDILLFLTGQEEIDTACEILYERMKSLGPDVPELIILPVYSALPSEMQTRIFEPAPPGSRKVVIATNIAETSLTIDGIYYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLCKMLIMSVALQCSDEILTIVSMLSVQNVFYRPKDKQALADQKKAKFNQPEGDHLTLLAVYNSWKNNKFSNAWCYENFVQIRTLKRAQDVRKQLLGIMDRHKLDVVSAERNTVRVQKAICSGFFRNAGKKDPQEGYRTLVDSQVVYIHPSSALFNRQPEWVIYHELVQTTKEYMREVTTIDPKWLVEFAPAFFKFSDPTKLSKFKKNQRLEPLYNKYEEPNAWRISRVRRRRN

SEQ ID NO: 11614 - protein, 415 aa, Phyllotreta cruciferae
MASKRKNKKNILAKVNFPLYTVQMVTSRHVIVGGGGGTSKTGVENGFEIYEIYHDGSKFSAKEVTRHETGGNVVMNCCVFSDRKHSFLVAGQENYSQLYGVNTKLIEHEQVETIGDTASVRHRNTKPKAHVDNNKNIKKELVFDMNPLDSIQTDFKGSEPLCRVVRINHSGKILATGGTDGDVRLWKFPTMQPLSILKGHTKEIDDIDFSKFDNLIITLAKDGLAILWDAQTGKLKSKLTWNTPEGSKYLYKRCRFGVIEDQKNKCMLYMIANATNSKQKSFLQQWIPEENTLKKFSEFNETLSALAVRDDGRFVAVGTMFSGSVSIHIAFSLQKILVVVGAHSMFVTGLEFLSHENTNHSISSVAEAAVLSISVDNQLCIHSVPYRRSIPLWIGIMVLILVLFFTFMLCAYMGL

SEQ ID NO: 11615 - protein, 413 aa, Phyllotreta cruciferae
MAGARVFERAQAVPSQHDKLLKLNPADEDDEENIVNKEQDILNLGEKYKKEGKAKELAELIKATRPFLSLISKAKAAKLVRSLVDYFLDLEAGIGIEVQLCKECIEWAKEERRTFLRQSLEARLIALYFDTGMYTDALQLESTLLKELKKLDDKNLLVEVQLLESKTYHALSNLPKARAALTSARTTANAIYCPPKMQAALDLQSGVLHAADEKDFKTAYSYFYEAFEGFDSVESPKALTALKYMLLSKIMINSPEDVQQIVSGKLAIKYAGKDIEAMKAVAQAAHKRSLADFQLAVKQFKHELEDDVIVRAHLGTLYDNMLEQNLCRIIEPYSRVQVEYIAKTIKLPVLQVEKKLSQMILDAKFHGILDQGDGVLIVFEETPVDKTYEMALETIQSMSKVVDTLYQKAKKLS

SEQ ID NO: 11616 - protein, 578 aa, Phyllotreta cruciferae
MASRSKKSSTPSAQQRPASPLSPTRHSRLQEKADLQNLNDRLAGYIDKVRFLEAENNKLSREIQTTQETVTREVSNIKSMYDHELSDARKLLDDTHREKARLEIDVKRLIEENEELKAELAKKSKDLVIAENHARIYETRCNEYQLKANQASADAKKAIADAKELEKERDKLKKLLDAARKQLEEESLARVEVENHNQSLREEIGFKDQIHQQELTETRTRRQVEISEIDGRLAQKYEAKLQEALQDLRDQYESQMANNRQEIELLYEQKIKNLQAAADRHQSTASGALDELRQVRTRIDTFSSRIQDLENQNQGLAARTRDLEKLLENERIRHAEDLALVERELHRLREEMATQLQEYQDLMDIKVSLDLEIAAYRKLLEAEEARLNITPTGVEHEVHQRSSSQRRTPVRMGAKRKRALLEETQESSMSDYSVNSSSKGDIEVAAADPDGQFVRLHNKSNQEVPLSGWQVIRRAGDEETFYKFHRTVKVEGNGTVTIWSSDLNKDHEPPSNLVMKSQKWVTGDNMITIVLNSNGEEVASSERVKRQISTSHLRHRELGDEELFHQQGDLQGEKCGLM

SEQ ID NO: 11617 - protein, 803 aa, Phyllotreta cruciferae
MADSKSPDDLATAILRKKDRPNRLLVEEAVNDDNSVVALSQAKMDELQLFRGDTVLLKGKRRKETVCIVLSDDSCSDEKIRMNRNVRNNLRVRLSDVVSIQPCPDVKYGKRIHVLPIDDTVEGLTGNLFEVYLKPYFLEAYRPIHKDDVFIVRGGMRAVEFKVVETDPAPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSEAALQQIREKMDLIDLEDDQIDAEVLNSLAVTMENFRYAMTKSSPSALRETVVEVPNVTWDDIGGLANVKKELQELVQYPVEHPDKFLKFGMQPSRGVLFYGPPGCGKTLLAKAIANECQANFISVKGPELLTMWFGESEANVRDIFDKARSAAPCVLFFDELDSIAKSRGGNVGDAGGAADRVINQILTEMDGMGAKKNVFIIGATNRPDIIDPAILRPGRLDQLIYIPLPDEKSREAIFKANLRKSPVAKDVDLTYIAKVTHGFSGADLTEICQRACKLAIRQSIETEIRRERERALNPNVAMDLDDDDPVPEITRAHFEEAMRFARRSVSDNDIRKYEMFAQTLQQSRGFGTNFRFPTAQGGPQAPGGTGGDQANFQDAPEDDLYS

SEQ ID NO: 11618 - protein, 274 aa, Phyllotreta cruciferae
MSDQFDCALDLMRRLPPQQIEKNLSDLIDLVPSLCEDLLSSVDQPLKIAKDKDSGKDFLLCDYNRDGDSYRSPWSNTYYPPLEDGSMPSERLRKLELDANLAFDQYREMYFEGGVSSVYFWDLDHGFAGVILIKKTGDGSRKIKGCWDSLHVVEVQEKSSGRNSHYKMTSTAMLWLQTNKQGSGTMNLGGSLTRQIESDAAVNDINPHIANIGRMVEDMENKIRNTLNEIYFSKTKDIVNSLRSVQPLTESRQQQALKQDLAAALQRRQNKSEN

SEQ ID NO: 11619 - protein, 701 aa, Phyllotreta cruciferae
MERPPRNEPPVEPVNGVVQPPVHPPPDSPGRVTNQLQFLQKTVLKAVWKDKFAWPFQQPVDAKKLNLPDYHRIIKQPMDLGTIKKRLENNYYWSGKECIQDFNTMFTNCYVYNQPGEDVVVMAQTLEKVFLTKVADMPKQEFVVDMPMKGAKGKKGRVSVGGGGGSTPSSSGPVPAAIVPGGVRGRPPATVSSTSTTPIATTTGSSGLPLGTQAPATLPGSTATTTIAPANNNNSSLTPQQLGTPVSSMHGTPGAPLSNSLDPSGVLPSNVMPPAQPAKVKKGVKRKADTTTPATAYDYPTVLESKSAKISTRRESGRQIKKPARREIDLHVPQPAIHKPNDKLSESLKACNEILMELFSKKHSNYAWPFYQPVDAELLGLHDYHDIIKRPMDFGTVKEKMDNREYRTPQDFAADVRLIFSNCYKYNPSDHDVVAMARKLQDVFEVKFAKIPDEPVNRIGGAVNNLPIKSESSSSGSSSDSSSESEDSEEERRNKQLKVLEKELTALQEKMRKLVEESSRRKKEKKKNKMKKKPSGGGMTAAGAGALPNSSSGLGKPSGHGALKSNNNSIADSVDDSIASVVSGADMKMSGAGATVAGESHHHAVGAQGAGALHPAGKSINMHHNMAAAGANASAQPKTPKSKGEILFNRFLFIYFYLLRYYALLQILQRMFVSRFGSAVYAIVCIFFAVFDSIILSGIVL

SEQ ID NO: 11620 - protein, 408 aa, Phyllotreta cruciferae
MSLSTARPLVSVYNEKSEEVKGNGVALPAVFKAPIRPDVVNFVHQQVSMNHRQPYSVSDKAGHQTSAESWGTGRAVARIPRVRGGGTHRSGQGAFGNMCRGGRMFAPTKPWRRWHRRVNINQRRYALASAVAASGVPALVMSKGHVVDQIPELPLVVSDKVQEMHKTKEAVQFLRRIKAWADIQKVYKSQRFRAGKGKMRNRRRIQRKGPLIVYYKDQGLRQAFRNIPGIDLISVQKLNLLKLAPGGHVGRFVIWTESAFQRLDKLFGTWKNPSTEKKGYNLPQPKMSNTDLSRLLKADEIKAVLRTPQKKVVRRVRRLNPLTNTKAMLKLNPYAAVLKREAILKNQKRQLQRDEALAKKRGITLTPDNAVIRTRKLQERRRAQILKDKKSKPKKAAKAPAKKPAGKK

SEQ ID NO: 11621 - protein, 1797 aa, Phyllotreta cruciferae
MADYLNSEAEESSEEEELDHRDRKKAQKAKLVDSSDEEEEEDDEEKIREELKDLIDDNPIEESDAESDASGREKRKKSDDEDLDDRLEDEDYDLLEENLGHKVERRKFKRLRRFEDEESEGEEEHDPEQDREQIAMDIFSDDEKDDRHKKDEERRSERSQRPVVEQESFGVGEEEEEGDYSDADDFIVDDDGRPLIEKKRKKKPIFTDAALQEAQETFGVDFDYDEFTKYDQDEYEDEEDEEEDEYEEDDNERRKHPKKAARKKLTKKSIFEVYEPSELKRGFFTDLDNEVRNTDIPERMQLRDVPITPVTDDSTELEDEAEWIYRQAFCNKAVSNVDAHLSAEAREKMKKGSQTVGKIKKALDFMRNQQLEVPFIAFYRKEYVQPELNINDLWKVYKYDAKWCQLKSRKENLLKLFDKMRHYQLDQLVKNPDAPIPDNVRVMKDSDIERLKNVQTAEELNDVHNHFILYYSGDLPAMHAAWRIKEKEQRKFEKRQKRLKQIAEAEEGADIPDEPEDDDDDEPETETLKYANRSGSYALCSKAGLDPLAKKFGLSPEQFAENLRDNYQRHEVDQEPVEPSDVAKDFISPKFSTADEVLQAAKYMVALQIAREPLVRKCVREVYFERARINVYPTKKGQKVIDESHNCYSMKYLKNKPVRDLNGDQFLKLCLAEEENLLTITINDNIEGNTSNSYIEEVKQLYIKDEFSKNVQDWNALRMECVERALTKSVLPDLRTELKRTLLSEAKEFVLKACCRKLYNSIKVAPYSITFPDEDEDEWDTSKGVRVMGLAYVPEYTVSAFACIAAPDGDITDYLRLPHILKRKNSFRTEEKLMKEADLQALKNFIFLKKPHVIAIGGESREALMIADDLKALINELVESDQFPEIKVEIIDNELAKLYANSNKGQADFRDYPELLRQAISLARKMQDPLIEYSQLCNGDEEILSLRFHPLQEQIGKEELIEALCLEFVNRTNEVGVDINLAVQQAHKSSLVQFVCGLGPRKGQALLKVLKQTNQRLENRTQLVTACHMGPKVFINCSGFIKIDTNSLGDSTEAYVEILDGSRVHPETYEWARKMAVDALEYDDDEGANPAGALEEILETPERLKDLDLDAFAEELERQGFGNKSITLYDIRAELNCRYKDLRQPFHSANPEELFDMLTKETPETFYIGKLVTASVIGIARKKPKPDQLDQANPVRNDETGLWQCPFCLKNDFPELSDVWNHFDAGACPGQATGVKLRLDNGIMGYIYIKNISDKPVSNPEERVGVGQLISCRIIKIDVERFSVDCTSKSSDLLDKNHEWRPPRDPHYDTEREEKDNRTEAEKKKEKQRLTYIKRVIVHPAFHNISYAEAEKCMVNMDQGEVIIRPSSKGADHLTITWKVADKIYQHIDIREEGKTNAFSLGKSLLIGNEEFEDLDEIIARHVTPMAAHARDLLYFRYFKEFEGGHKDKAEEYLKDEKKKNASKIHYVVSAAKHLPGKFLLSYLPRNKVRHEYITVTPEGFRFRQQMFDSITSLFKWFKEHFREPPPGGMTPGTPRMSTGRTPYDMSTEAIQRVAQNLPSDMVQALSAATNQTPHYPHTPGGYGGNYINTPYTPSGQTPYMTPFQTPHAQQTPRYGQQTPSQPSLSNPFLHPGAVTPSQRTPSYRNLSSQSPMIPQSPVPSPGSQSSYSSHMSHHTRASYGDSMRFQPPESPRNYPSSRGSYPDGRYGGSESMDWQKAAEAWASRSRSTPRSEGRGTPRSSGHRTPRNYDNMSESDRSRMKHMSSKSPKSVRSTPRTNSSPRSMSLGDATPLYDENI

SEQ ID NO: 11622 - protein, 863 aa, Phyllotreta cruciferae
MPEVDDSETRSPRRKRRRSKSADRKEEKSSKRKSSRKRSSDDDYNERDYPRYYGEDRPNSDSYWNKYPRRENMKVGRRYYDHPEHEKNRDRDRDASNERSRDRESARGKEYSKKEENEDKSIIKPRERKVVDMLTSRTGGAYIPPAKLRLMQESITDKSSAAYQRIAWEALKKSVHGYINKINTSNIGIIAREILHENIVRGRGLLCKSIIQAQAASPTFTNVYAALVAVINSKFPNIGELLLKRLVLQFKRGYKQNNKSICISATTFVAHLVNQRVAHEILALEILTLLVETPTDDSVEVAISFLKECGQKLTEVSSKGITAIFEMLRNILHEGQLEKRIQYMIEVMFQIRKDGFKDHAAVTEELDLVEEEDQFTHLIMLDDVKEVNAEDILNVFKFDEHYEENEGKYKTLSKEILGSDSESESGSEGSEEESDGEGEDEEIKDAGKIIDNTETNLIALRRTIYLTIQSSLDFEECAHKLLKMELKPGQEIELCHMFLDCCAEQRTYEKFYGLLAQRFCQINKIYIEPFQQIFKDTFATTHRLDTNRLRNVSKFFAHLLFTDAIGWEVFEIMKLNEEDTNSSSRIFIKILFQELAEYMGLGKLNARLKDETLQQHFAGLFPRDNPKNTRFSINFFTSIGLGGLTDELREHLKNVPKIMEIKTTAVREKSESSSSSSSSSSSSSEEDSSDDSSGDSSSEDEKQREKSKKKKKKRESESKSSKSDSKINRKAEMRDRGKHKKNKDKEDRKETHKNKENRSDSDKHVSREKQNSRQDKRKDDGDIKEKHRKDDREDRERQRRNEEKSGRKKDYEWVKSRHEDNIHQLKTSKKVFEKPSKHRSRSRDKISSKEKDRKHRSKERRKS

SEQ ID NO: 11623 - protein, 595 aa, Phyllotreta cruciferae
MALKNQVGQKIMNEVIKHKASKKNGPAVTQPHNASGVDWRILVVDQLAMRMVSACCKMHDISAEGITLVEDIMKKREPLATMEAVYLITPSEKSVHALMNDFESPRPMYRGAHVFFTEACPDELFNKLSKSHAAKYIKTLKEINIAFIPTESQVFSLDSPDTFQCSYDPSFAAARNANMERMAEQIATLCATLGEYPHVRYRSDWERNVELAQLIQQKLDAYKADEPTMGEGPEKARSQLLILDRGFDCVSPLLHELTFQAMAYDLLPIENDVYKYEASAGVQKEVLLDENDELWVELRHQHIAVVSQSVTKNLKKFTDSKRMTQSDKQSMKDLSTMIKKMPQYQKELSKYATHLHLAEDCMKAYQGYIDKLCKVEQDLAMGTDAEGEKIKDHMRNIVPILLDTKITNEYDKMRIIALYAMTKNGITEENLTKLATHAQIKDKQTIANLQLLGVNVINDGGPRKKIYTVPRKERITEQTYQMSRWTPVIKDIMEDCIEDKLDQKHFPYLSGRAQTTGYHAAPSSARYGQWHKDRGQQAVKNVPRLLVFVVGGISFSEIRCAYEVTNAQKNWEVIIGSSHILTPEGFLSDLATLAG

SEQ ID NO: 11624 - protein, 712 aa, Phyllotreta cruciferae
MMQQYMKELEQEPFDAEEFVERLAWRTLAESKSEGEENEINPALLHESFVQAIKDLNLLHERQQKKCEKLEVAVREDEATFFQEVYNLLEQNKQAMDTFQELDGKINHVATKVLHLGDQLDSVNGPRSRVVDALSLMTHLREFLSNEPVSSTIFTNEEYIDEAADVIQKLYLISQDLPPKFESIKRKIERKYSDIEKTLIEEFVGAMDNENLTRMKEIALVLSQFKGYSQCIDSYIDHSQVGCLSSKDVFYNFLNLCKYNDEIIRKVFKNPEQVMAKFVLNIYQLKLVEYIDQKLNSKLGTYSYLQTLYELYSKTNHLSSELTVFHMGNDKNYLTKLTTNIFNKYINDYISMELKCLKDRCSTNLQKYYDSKNHQKKQIQSGGFQDLRRDLQAVIGTRANINIAQIENYGGETFLSEELAIMILQDTKQAFQRCLLLSKGSERASNATQILDRLINSLLIEHVDYAVELGLHAVPVVEGVRNPPVLYFFNIVHQSNNITHLVEKQFMDLVVPLVENTSKYSDCIQKKKFVLEDIERKINTGLDRCLSAILNWVKLYLQSEQKKSDFKPESDDFDTVASPACKNVLNYVNSIIKEIKTNLDGNNVTAILQELGIRLHRVVYEHLLQYQYNTAGAMVAICDLNEYRSCTKQLGPLVAELFDTLHALCNLLLVKPENLQQVCSEDSLVKLDRAILHSFIQLRSDFKVQKQTILKV

SEQ ID NO: 11625 - protein, 270 aa, Phyllotreta cruciferae
MDFQNRPGGKTGGGGVASWSETNRDRRERLRQLALETIDLQKDPYFMKNHLGSYECKLCLTLHNNEGSYLAHTQGKKHQANLARRAAKEAKDAPTLLQPEKPRVEPKKVVKIGRPGYRVTKQRDPETGQQSLLFQIDYPEISDLVLPRHRFMSAYEQKIEPPDRKWQYLLFAAEPYETIGFKVPSREVEKTDTKFWTHWNRDTKQFFLQFAFKNENKRNVNSVVQRHSIVGGVPPPPMLPVPPPPRPPMFNPIPPPPPMMRAVLPVPPPN

SEQ ID NO: 11626 - protein, 133 aa, Phyllotreta cruciferae; identical to SEQ ID NO: 11398

SEQ ID NO: 11627 - protein, 442 aa, Phyllotreta cruciferae
MATNLSRTSLLRIINARGYAACPHPLSGVPNAEVKSTILPNKTVVAAVDNNASLTRVSIVFRAGSRNEDPDNLGVAHVLRTAAGLSTKNCSQFAIIRNIQQLGANLTATSDRETICYTLEGTPEAVECAIPFLTEVATQQEFRPWEISELSGRLQLDIATRPLQLRAIDLLHNAAFRGRGLGNSLFIPKTQIGKISSETLQHYVASNFVSGRMAVVGSGISQKELTSFANSLKIENGEGNNAPSPYVGGELRSNKGGQLAFVAVAGEGAAITNTKEALAFAVLQGALGGGPQVAHGVSDNGVFRKALGSNPNVSSVAINASYSDTGLFGLLLAVPTKSAGGALETAVKVLKSGTVSDEDVRRGKNQLKTSILFGAESGADIVRRIGQEAVLTQKATSVDALVADVDSVSTSDVANALKKAGKKLSLASVGNLAGVPFLDELK

SEQ ID NO: 11628 - protein, 110 aa, Phyllotreta cruciferae
MRRAHAGNYYEPLPQNSNEIEDENDRMTNELQEKIGALKSLTIDIGNEVKYQDRMLRDVDDDLEKTGGFLGTTMNKVLRLSKGGHNYIIVYLFLFSIVVFFILYCVIKFR

SEQ ID NO: 11629 - protein, 496 aa, Phyllotreta cruciferae
MSYPSTLNAKQAAQEHVLAVSRDFVSQPRLTYKTVSGVNGPLVILEDVKFPKFNEIVQLKLADGSLRSGQVLEVSGSKAVVQVFEGTSGIDAKNTVCEFTGDILRTPVSEDMLGRVFNGSGKPIDKGPPILAEDFLDIQGQPINPWSRIYPEEMIQTGISAIDVMNSIARGQKIPIFSAAGLPHNEIAAQICRQAGLVKVPGKSALDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHSDVSNQLYACYAIGKDVQAMKAVVGEEALTPDDLLYLEFLTKFEKNFISQGSYENRTVFESLDIGWQLLRIFPKEMLKRIPAATLAEFYPRDSRH

SEQ ID NO: 11630 - protein, 806 aa, Phyllotreta cruciferae
MSYMQTNQNRPMSQGYHQGANDLPMQSSKEQTLLWQQNSYMGDSGIQSGAATQVPSLSGKEEEEMDLFDLDQPYQGFTQEQVDEMNNQLNHTRSQRVRAAMFPETLDEGIEIPSTQFDPNHQTAVQRLAEPSQMLKHAVVNLINYQDDADLATRAIPELIKLLNDEDQVVVSQAAMMVHQLSKKEASRHAIMNSPQMVAALVRAISNSNDLETTKGAVGTLHKLSHHRQGLLAIFKSGGIPALVKLLSSPVESVLFYAITTLHNLLLHQDGSKMAVRLAGGLQKMVALLQRNHVKFLAILTDCLQILAYGNQESKLIILASQGPIELVRIMRSYDYEKLLWTTSRVLKVLSVCSSNKPAIVEAGGMQALAMHLGNPSTRLVQNCLWTLRNLSDAATKVDGLESLLQSLVQVLQSSDVNVVTCAAGILSNLTCNNQRNKVTVCQVGGVDALVRTIVSAGDREEITEPAVCALRHLTSRHVESEMAQNAVRLNYGIQVIVKLLNPPSRWPLVKAVIGLIRNLALCPANHAPLREHGAIHHLVQLLMRAFQDTQRQRSSVASGGSQPPGTYADGVRMEEIVEGTVGALHILARESHNRAIIRQQMVIPIFVQLLFNDIENIQRVAAGVLCELAADKEGAEMIENEGATAPLTELLHSRNEGVATYAAAVLFRMSEDKPQDYKKRLSMELTNSLFREENLWNPDLGMGPDLQDILSPDQAYDNMYAQGPPSVHSSHGGRPYQQQGYDQIPIDMQGLEIGSHGGGNGSTYSAIDAMDVTSGEPDLNFDTIDQLPTPPQDNNHAAAWYDTDL

SEQ ID NO: 11631 - protein, 266 aa, Phyllotreta cruciferae
MARNAEKAMTTLARWRAAQLGEIDKHKKRRPYLASECKSLYACEKWRMQIIREIAKKVAQIQNAGLGEFRIRDLNDEINKLLREKRHWEDQIKELGGPDYQRVGPRMLDHEGKEVPGNRGYKYFGAAKELPGVRELFEQEPPPPPRKSRAELMKDIDADYYGYMDDDDGILIPLEIKAEKIAVQNAIAEWVNNKEKNLDPAKGIEESIYVVEDSDEEDVVQQFDGSQQRFVAHVPVPSQQDIEQALLRRRKQELMEKYGVQDEQDL

SEQ ID NO: 11632 - protein, 803 aa, Phyllotreta cruciferae
MPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEEGEDAVDDPRKLKPGEIDPNPETKPARPDPKDMDEDELEMLSEARARLANTQGKKAKRKAREKQLEEARRLAALQKRRELRAAGIEVTSRRKKKRGVDYNAEIPFEKQPAIGFYDTSNEALDLMAPDFSKMRQQHLDGELRSEREERERKKDKQKLKQRKENDIPQAMLQNEEPAKKRSKLEQKLKQRKENDIPQAMLQNEEPAKKRSKLVLPEPQISDQEMHQVVKLGKASETAREIATESGVETTDTLLNDYMFTPQAAATPRTPAPQTDRILQEAQNMMALTHVDTPLKGGLNTPLHNSDFSGVLPQSQAITTPNTVLATPFRSTRSDGGATPGSTAGFMTPKSGALTPVGKNATPSIRDKLNINAEESLDVGSTPAEHRMFQMSMKDQLKLGLSSLPQPRNDYEIVVPENEAQDEPEEAQAQLVEDQADVDARKQEELRAKAAQELASRSQVIQRELPRPQEVNLTVLRPPNESYSLTDLQRAEELIKCEMVTMLQYDNLKNPLPAQSKRSNMSQAQQLAFLEQHPYDSFKKEDLDVAKTLLRSEMDVVKNGMNHGELPLEVYNQVWEECLSQVLYLPNQTRYTRAHLASKKDRLESAEKRLEQNRSHMAKEAKRAAKMEKKLKILTGGYQSRAQVLIKQLQDQYESIDQSTLELNTFKFLAEQEKNALPMRIQSLTEDVNRQMEREK

SEQ ID NO: 11633 - protein, 151 aa, Phyllotreta cruciferae
MMQFMLLFSRQGKLRLQKWYVAHPDKLKKKITRELITTILARKPKMCSFLEWRDLKIVYKRYASLYFCCAIEQCDNELLTLEIIHRYVELLDKYFGSVCELDIIFNFEKAYFILDELMLGGEVQETSKKNVLKAIAAQDLLQEVSHGNIEL

SEQ ID NO: 11634 - protein, 457 aa, Phyllotreta cruciferae
MYGLQRYSFSYTLKNAVRYYSREPAKRSSFLSRLYDNFKDEMNKNKEMKESLKKFREEAQKLEQSDALKAARQKFETVEKEASKSGEVFKESLGSIKERVKGVIDEASKSDLAKKAGKFTEEVGKTTHKISETAQEISKTGAFQSISEATKAVKQEIDNTSMEGRVYVSPKKLRKRTETSAVVQQKYYEPNTDATGVELHKDSKFYESWQNFKNNNPYVHKVMDWKLKFDESENPIIRASRALTEKVGDIMGGLFQKTELSETLTEICKIDPDFDTKRFLKQCETDIIPNILEAMTRGDLDVLKDWCHEGPFNLFAVPIKEAYKKGYKIESKILDVDHVDLVMGKVMDQGPVLIISFTSQQVMAVRVPNILEAMTRGDLDVLKDWCHEGPFNLFAVPIKEAYKKGYKIESKILDVDHVDLVMGKVMDQGPVLIISFTSQQVMAVRDPSGAVVEGDPD

SEQ ID NO: 11635 - protein, 307 aa, Phyllotreta cruciferae
LKFIKMSSSDSELSDSDAELQQALLDGKLKPGLNKIEQAPKQFVNNISGLNQKIEEFKLNLPWIERLDCTNAQAPLAPELAEEMLAHEEKRSNQLRNNKKLPQFQPSEDPVLNDFKRELIFHRQAQATILDAIPKIKELGISTKRPDDYFAEMAKSDEQMHKIRENLKQKQEQQKRSERVKQLRQQRKEGKSLQVQLKLQRSKEKKEMMDQVKKARKNFDFLDEKNKPMGKNKVAERRKMKDKKFGFGGKKKGMKKNTKDSAGDISEYRNPGKAKKQMGNKFVNKNKPKNQRMGKNRRIKTKAKGKK

SEQ ID NO: 11636 - protein, 583 aa, Phyllotreta cruciferae
MNPSAPNYPMASLYVGDLHSDITEAMLFEKFSSAGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDESGVSKGYGFVHFETEEAANKSIEKVNGMLLNGKKVYVGRFIPRKEREKELGEKAKLFTNVYVKNFGEDLSEEQLRTMFEKYGKITSYKIMSKDDGKSKGFGFVAFESPEAAESAVEALNGKEILEGKPLYVGRAQKKAERQQELKRRFEALKMERLNRYQGVNLYVKNLDDTIDDERLRKEFSPFGTITSAKVMMEEGRSKGFGFVCFSSPEEATKAVTEMNGRIVGTKPLYVALAQRKEDRKAHLTSQYMQRMANMRMHQMGQFIQPGGSSGYFVPTIQATAPRFYGPAQMPIRTSPRWPAQTPVRPGAQGSTATYTGMPNSYRAAARPPGQSTMRSNISVPRPITGQQPPSMHGRPLVGQVWLLPEIVQPTSNTPPTCVIHRKRCYPELKLKYSKQSIFKGRNPLLLPCWPLLLRRSRNKCWENDCSLSFKECIQIWLVKSPVCCWK

SEQ ID NO: 11637 - protein, 855 aa, Phyllotreta cruciferae
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSGLVEDQGFLEQLKELLSDSNPMVVANAVAALSEINESSPTGQPLVELSTNTINKLLTALNECTEWGQVFILDSLSNYTPRDEREAQSICERITPRLAHANAAVVLSAVKVLIKMMEILAGDTEFCNTLSKKLAPPLVTLLSSEPEVQYVALRNINLIVQKKPDILKHEMKVFFVKYNDPIYVKLEKLDIMIRLASQVNIAQVLSELKEYATEVDVDFVRKAVRAIGRCAIKVEPSAERCVATLLDLIQTKVNYVVQEAIVVIKDIFRKYPNKYESIISTLCENLDTLDEPEARASMVWIIGEYAERIDNADELLDSFLEGFGDENAQVQLQLLTAVVKLFLKRPQHTQGLVQHVLSLATQDSDNPDLRDRGFIYWRLLSTDPAAAKEVVLADKPLISEETDLLEPTLLDELICHISSLASVYHKPPTAFVEGRSAGIRKTLPARQGSDDTAAAPETTVIPNQESLIGDLLSMDINAPAPAAAAPAAPQTSNVDLLGGGLDVLLGGGNDIGAAPASAAAPTTTGLLGDIFGIPTAPTMYTPPKVIWLPAEKGKGMEIYGTFSRRSGQMAMEMTITNKAMQAMSGFAIQFNKNSFGITPSAPMNIPTLQPGQNLEYSLPLNTTGPVQRMDPLMTLQIAIKNNVDVFYYACQIPIQILFGEDGTLDKRVFLTTWRDIPGANEVSMLVNINVVWYGVYNFRGIKNV

SEQ ID NO: 11638 - protein, 165 aa, Phyllotreta cruciferae
MPPKFDPTEVKYVYLRCVGGEVGATSSLAPKIGPLGLSPKKIGDDIAKGTADWKGLKITVQLKIQNRQATISVVPSAASLIIKALKEPPRDRKKQKNIKHSGNITFDDVISIAKQMRHRSMAKSLSGTIKEVLGTAQSVGCTIDGKAPHDVIDEVNEGTVEVPDE

SEQ ID NO: 11639 - protein, 364 aa, Phyllotreta cruciferae
MSEEGKRALILVGGYGTRLRPLTLSRPKPLVEFANKPILLHQIEALVDAGVTEVILAVSYRAKQMEEELTVEAAKLGISIVFSHETEPLGTAGPIALAREHLSKSTKPFFVLNSDIICDFPFRELEKFHEGHGKEGTIVVTKVEEPSKYGVVVYDQNNCIESFVEKPQEFISNKINAGLYILNPSVINRIELRPTSIEKEVFPYMASDQQLYAFELKGFWMDVGQPKDFLTGMCLYLNHLRETNSQKLYKGPGVVGSVLVDPTAKIGSNCQIGPNVTIGPGVVIENGVCIKRSTILRGATVCSNSWLESCIVGWKCHIGKWVRMEGSTVLGEDVIVKDETYINGGQVLPHKSIATSVPEPQIIM

SEQ ID NO: 11640 - protein, 288 aa, Phyllotreta cruciferae
MASEGEEVISDQEKVKIVSDFILHSPPGEFNEVFNDVRKLLNNDDLLKEGVTGAFAQYNKDQLTPVRIENADQMVLITEYNDLGNNRFFDPRSKQSFKYEHLRKEASDYQPYSVDTAAEPWRAALDNEFIQYTRNHYKDGVCSVFARSQNGAITLTACIEDHQFQPKNFWNGRWRSQWSVSLTDEATAEVRGVLKVQVHYYEEGNVQLVSTKEIKESIPVSNEAQTAKEIIHVIEQAENLYQTAISENYQTMSDTTFKALRRLLPVTRTKMDWNKIVSYSIGKELKTQ

SEQ ID NO: 11641 - protein, 1186 aa, Phyllotreta cruciferae
MNFLLVLIISAVAVGAQEGVAPDAAGQDNTGDVESIDVGASGGDEGVDSKPIPVEENGGSVTTNINYDPMTSDTAPQDTDQRGGGLPYSITETRLAEIRKNFMYPFFDKGGNVDNEGDYQKEIQSSTPQVHKNLNFQLPFFGFRYNYTRVSINGYLEFSDPPPNLDYPLVFPVKDWPKENDPSFIGIFYSKCKIGNLRDEDSDKRKPGVYFRMERDLRDRQDRMGVEIRERLKWDIREGVIGSETFNPKHAIIVTWKNVSFNGGYANAVYQTNTFQMVLATDEVFTYAMFNYLNLDWTSHTEAGGDTRKGEGGTPAFVGFNAGNGTRSFQYAPYSQASVIRDLTSTGWGNNKPGRHIFRIDENILLGSCNKDIDGANLPLQFAPESGNMLGGTVVNITGPCFQPNDRIRCKFDVYDEVVGFVVDRNRAICIQPRLYSEGWVRLQIAINSDAFKWKGKYYVESPASASQKIFFKDMKYHEKSPSEIRITWQKQNLTTNENANIRISLWGYRETTMRPTFVYITEIADNVQNTGEYTIVPSQYRGKINQFLTDIKFGFLQINLTESIKVNIYSTNNQNIDITPIIWSRPIPLGWYFQFQWENQYGKNWPKQLCDDWLRTDRYLKNFAHELPQCPCTVQQALADKGKFMPDFDCDKDSNPVCYYNNQALHCVKTGAPTMEGSEQQCCYDKNGYLMLSYDQQWGSSPRRCHNLGKMPYNEATKVPTLSQWFNDIVPKYLCCLWQEEQAVGCETLRFERRPSQDCVAYQAPAVAGVYGDPHIVTFDDVEYTFNGKGEYALVKSLKVDDNLEIQARFEQMDINAYGEVRATQLTAIVAKGNKTIPIEVRRRPLEARWRYRLDVIAENRRLFFDRPSLKFQHFQGVTVYTPTYILNQSEVLIMFDNGAGVEVLDNQGYMSARVYLPWSFINKTVGLFGNWSFNKEDDFTLPDGSKAAVVSNINDMERVYNDFGSKWMLDDVGDAHKGQSLFYREFGRTSATYNNKTFKPQFLMLPEDILPPNRSEQIQRTYDVCSTKMYECYYDYAMTLNRDLAHFTQNYKATIYELKQTTREKITSCGVLETPRFGRKSTFLFVPGTKVTYECIQDFVLVGDPRRECGGDGKWNIPDYGYTYCLRQQEYSQRQAGITSGIIMLVLIPLILLFVYLAYRFLKKKQKEREENRLEQEQYREQSR

SEQ ID NO: 11642 - protein, 113 aa, Phyllotreta cruciferae
MRYVAAYLLAVLGGNASPSSADVEKILGSVGVEAEAEKVKKVLGELKGKSIEELITKGREKLSSMPVGGAAPVAAAAVAAAPAAAEEKKESKKEEKKVESESEDDDMGFGLFD

SEQ ID NO: 11643 - protein, 906 aa, Phyllotreta cruciferae
MTDRFGLKWDPKNLEIRTMSVEKTLEPLVLQVTTLVNTKGPSKKKKGKSKRANALVSTVEKATENFIEKGEQIAYENPDITDEMIAAVEEVRKTGNAMSIAAREFSEDPCSSLKRGNMVRAARNLLSAVTRLLILADMVDVHLLLQSLHVVEDDLEKLKNASSQGELLDNIKAFGQNANELMNQAAKRQQELKDPQLRDDLAAARAVLKKHSTMLLTASKVYVRHPELAAAKANRDYVLKQVCEAVNTINDVAQGRTPQPASGPYDGPGELAAALDDFDDHMVMEPLAYNEVHTRPSLEERLESIISGAALMADSSCTRDERRERIVAECNAVRQALQDLLSEYMTNMGKKDKSENLNRAIDNMGRKTRDLRRQLRKAVVDHVSDSFLETNVPLLVLIKAAQNGNEKEVEEYAVVFTEHSNKLVEVANLVCSMSNNEDGVKMVRYAAAQIDNLCPEVINAARILAARSRSKVAQENMEAFKQSWENQVRILTEAVDDITTIDDFLAVSENHILEDVNKCVLALQEGDADTLDRTASGIKGRSNRVCNVVTAEMDNYEPCIYTKRVLEAVKVLNDQVMPKFTQRVQVAVQALGNSPPKEVDENDFIDASRLVYDGVREIRRAVLMNRADEDLDPEDVELDENYLIETRSKSSAHTGEHGVDEYPDISGITTAREAMGKMPEEDKQKILQQVEFFKSEKLKFDREVAKWDDTGNDIIVLAKHMCMIMMEMTDFTRGKGPLKTTMDVINAAKKISEAGTKLDKLTRQIAEQCPESSTKKDLLAYLQRIALYCHQMNITSKVKADVQNISGELIVSGLDSATSLIQAAKNLMNAVVLTVKASYVASTKYPRQGTVASPIVVWKMKAPEKKPLVRPEKPEEVRAKVRKGSQKKVQNPIHALSEFQSPTESV

SEQ ID NO: 11644 - protein, 406 aa, Phyllotreta cruciferae
MSFNFGNTGTPKTAATGFTLPPNPATTSATGLQFNFGGGDTKTEVKPSSTLFPAATSTPPAFGITPKPATPASAAPSFNFGTPTTQQTTASAFGTATPASFSTPTSSLQFGLTTTKPETSAGLFGSTAAATPISASTGLSFGTAVSTTSSATTAATGTPLFGVAPTSSTTTIASVPALGLSTTVSAAASTTPSTSLSTTTAPPAYSTSTLPSSGSLTFSQLEDSINKWTIDLEEQGKFFINQAKQLNAWDSLLISNGEKILNLNGSIERVKQQQQQLDQELDFVLAQQKELEELITPLEKELLEIPVTDIDRNQMYQFSEIIDSQLKQMSDDLKEIIEHINESNKSEEISNPLTQISRIMNAHMNSLQWLDRNTAQIVSHLEQISKMQDSNRRNFPLNHSFNNSLL

SEQ ID NO: 11645 - protein, 193 aa, Phyllotreta cruciferae
MFIWDWFTGVLGYLGLWKKSGKLLFLGLDNAGKTTLLHMLKDDRLAQHLPTLHPTSEELSIGNMRFTTFDLGGHSQARRVWKDYFPAVDAIVFLIDANDRSRFGESKRELDALLTDETLANCPVLILGNKIDLPDAASEDELRNVYSLYGQTTGKGKVARSDLPGRPLELFMCSILKRQGYGEGFRWLAQYID

SEQ ID NO: 11646 - protein, 187 aa, Phyllotreta cruciferae
MDPIAVLEKRIEALELQVFPLGDYAQISNKTQTITNLLVETQTMINSALTCRESITSMLQHLVVINDYLNPASEADELEVEAKRQYLLELYPELKDTIQTVSTLESLLPFIDSINISKVVEFSGKLEEVAVGNLKLYGECRDITKKVLVALQQYNDISNSIKLLFSQLDTAVTNLEYALQLRDANEE

SEQ ID NO: 11647 - protein, 583 aa, Phyllotreta cruciferae
MNNAKFQEVYSDLTLYTTPDKFFIEPKAGEELMVIERNSENIICFKSDHRHLIPAANSRKDFCGLIGIIQLLACPYLVVAVQRELVGYIAGCAVWRLAKAELIPYRSSAHLTPEKQADNDVYLSMVYSVLSTPFLYFSYDYDLTHSLQRLHGISPDFWKQSLFERADQRFVWNGNLLYSFKGFSIHRFCLPLMHGFVSINFCVVNGHSLNWSIVSRRSVQRAGTRLHRRGLDKEGNVANFVETEQIIEYQGDRASFVQIRGSIPLFWQQDPDLRYKPPPTLLDVDPQDQHSMCLKHMNDLMTFYGKIVCVNLVDQKGAEGNMEVAFKNAINNVSSPSVKYESFDFHAECSKMRWDRLSILIDRLAHDQDEMSFFLLLRDGSLSSLQDGVFRTNCIDCLDRTNVVQSMLAHRNLESVLRKLQILHQNQTLEFQYSFEVLFKNVWADNADIISTQYSGTGALKTDFTRTGKRTRYGLLQDGMNSMTRYYKNNFADGMRQDAIDLFLGNGKPLSPLHIDKGWKYVTYPSILLIAVAMFVACAVTPSEYSTDSLLFLLFWGSMVYATLHTILKYGSEFVDKPRLTHS

SEQ ID NO: 11648 - protein, 260 aa, Phyllotreta cruciferae
VLTEHDLGVSIDLINKDIYAIGAGAALDPADEKLLEEDILTPQDSKRSRHHAKSVSWLRRTEYISTEQTRFQPQTMDKVEAKVGYSIKKSLNNETLYMDRDSQIKAIEKTFEDTKTIIDKHYSKPNVVPVDVLPVYPDFSLWKYPCAQVIFDSDPAPVGKQVPAQIEEMSQAMIRGVMDESGEQFVAYFLPTEETLQKRREDVANQVQYQDEEEYEYKMAREYNWNVKSKASKGYEENYFTGSNRGDVSSYDSGCNGRKR

SEQ ID NO: 11649 - protein, 389 aa, Phyllotreta cruciferae
MPIENLEDQGLEKNPDLELAHYKFLLTLPEYRSDRNVHSKITEAIKKDDMAPWYELLCKEVGWKLDAALLKALKAKNSEKVKLLDEAIEDAEKNLGEMEVREAYLRKAEFYSRIGDKENAVTTFRQTYDKTVSLGHRLDIIFHLIRIGLFFMDHDLITRNIDKAKTLIEEGGDWDRRNRLKVYQGAYCMSVRDFKTAANLFLDTVSTFTSYELMDYKAFVRYTVYTSIISLPRNQLRDKVIKGSEILEVLHSEPFVKDYLFSLYNCQYAEFFSNLAEVETILRKDYFLNPHYRYYVREMKISAYTQLLESYRSLTLQYMAEAFGVTIEYIDEELSTFIAAGRLHCKIDRVGGIVATNRPDLKNAQFNSVVKQGDLLLNRVQKLSRVINI

SEQ ID NO: 11650 - protein, 4768 aa, Phyllotreta cruciferae
MLTTASPCLTCGSIGDIANLMFCSGCGAHYHGICVGLAQLPGVRSGWQCRKCRCCQVCRVVGDESKLMTCEQCDKIYHASCQRPVVTSIPKYGWKCRCCRVCGDCGARTPGAGLSSRWHAHYTVCDSCYQQRNKGFSCPICHKAYRAHAHREMVQCSSCKKFVHGTCDPEADVVTYNQKKEISIDYEYVCLHCKNSTARQITAKRASIDDPSDVSASHDSLYDDTSEFDLPSPDEFARNMGLGKGKPYSANKIAKKRLSFTVNPVGRPKGTGKVPPGKMGYMKRYRLTEFNRKRGPKAKMRGIFGVPGVGLQRPISDGKTDEEPGVENRLVLCSAKDKFTLTQDICVMCGAFGTDQEGCLISCVQCGQCYHPYCINVKVTKVILQKGWRCLDCTVCEGCGQRNDEGRLILCDDCDVSFHIYCMDPPLDYVPHGNWKCKWCAICQSCGTTDPGFNCTWMNSSTQCGPCASHVNCPSCNEPYGEGDLIIQCVQCERWLHGACDFIKCEEDAEKCAEEGYNCILCRPRDVPPPHMVPAAVTPKPPTPTKSPELGKSTSYYMDGVCLSEFGSNLIKSLALEYHGSRKKRKKIPTVQDKEAGIMATIESVVAGGNVIPTNMEDSAKLELVDIKDEPQELYKEGMMWTKEDGPPPEGFTIITMENGLNVLRRKRQRNLQKLGIGGFVVRMRGIRTGQDNDDVDSSIGQSGLNANDIVPSPADGDKPRRKTIRRKPKSKLAETFPAYLQEAFFGKDLMDTVDCKKEEVDCYSSDDEKTDKHFKSINLSQDEIIAIVASGKTEKLENNNKDSTKEVKPTVLKEEEEDNPEDLKDVLALPGDLLDTDLVNSIMEDEEELSKTTASLVALDSNLQHDTELTDTLSSSGNSKETKDELSDILGPHFNLDSIPNINSKDVEDIFKGVLTDESQESQESSSFSLQGNNMFSSNNAQQNVAQHPIINQAVRPKTLPTVNHNLNSPVSFPPPSPYHSEYSNSPQFSPAFTDSSCSWVGGNETPEIDSTNVTVTSTYNQRSSDKMKADESLGKSATISAVLYANINHPEWKKEYPNWPDRYKQIIKKWRTLSQEQKAPFLQHARDNRSQLRMKKAQQSQTVKETASTATSPNATKPLHQAGPALVTTLQAVTQQPAGAAAAPAPPVSEDQEKIALQQKSAREAEQERQWKQLQALRQQQTQQTQNILHEQRVQAIARVQRQISTDPAQQFINEQQSPLQVNTPQELSPSTTPAPSPRPFLGIKSPTFPVPSPVPQTGVRANTPSQSPHDISQPSTPDGNDHFIHSPTNPKPNFQPRLPNDPFAAQPATPRPQFGMARPPLQNFGGTVRNEQQDININRQLRELLQRQQVKKLDELLPGKAPPQRLWHANDQQEAGDASMTSAVQGAGAQGTDATFRQPLPPGVVKPRLAISSVNRPILGTVRVNQLDPRIQNLDPRMRLILQHQQQRLATGIQQQFIRFTSNVRPTTVEQYEQLLQRQGNNQNQIHAEEQQQGVARIPIAQASVIQRPHVAQAVVTGAAAVTTSTTESNSSEEGIPDNVTAELEKLEQETGTMVELQGVSDILGGLDDDDELLAEMGADFNILEYADPELEALTGGKTNILDLELEEEPVKKEKLASNANTCAPSQKPTPNVATTAISNSTSVTTPTEANAEPKIENTIQQSIPKSTPQQLQHPVSLPQQQNIPQHGAQVQVQSQQSQPHPPQQMPIQSTLHIQQIHQQMVHQVQQAAAQGRPMPPGSKMQTTDGFVGVVMANNAVQLQIPPNYQQRLLLLQQLQNQKLMRVGSTQPRAALQVAPNQMPVGMNPGARMPVSAPPPPPPPYPGPPPPYPGNANQHQQEQPLLLEDLLEQEKREQEKLQNQPPNHEVTSSTGNETESALLSDQDFERLKADVFNSAPVSNISSTNQGNAAQTPQAWPQLQNRQAVVPAAASQHTMEVTTRVQMYNPNLIPAPPLPPENIATEQDKQAQLLYEQWLNHQNNSLVQQLRYYETEVQKLRKSKKSLNSKQRQLRKAGNQLTDADATELQRITAEQAILQKHLESSRKQNRQHGMLIQEYRNKHPAIKQRTVTDQIQSPLGHPASSPIQQSSASLSPMLSPSVSPMTQNSSPLNSPGPMVPSSPGHSAVQNILQSPNGANAAQMSPMQASPMQSSPRIGTPHSQSDESPGSAQSPSQVCLPPPMPRMTSPQHRRVVTSPVGMSQMRFINNNMLQQRVRMQSPIQNFQQKPGTPSPLNSPTSQQMNVNQQHQIQKQLQQQQQQQQQQTLLQQNLEGDPNAIHSQRTTQLLQHRNFIRQQVSQQQISPQTLTPQQHQLMLQQQKQLAQQQQQQIAQMNAARLQQQQQQQQQQQQQNNPPHSPMPPKSPMINQQIMSPHSMPQSPMQMPPKSPMVPFNPNQTNPNSPAARSPAFHQGMNQPTSPITHGHQPPSSPMPRSPMINQTHSPHNVRRPPSANSSPAMPDRPHSVENSSPRMYSIDQLVQESLANQNVNAQYNSYNSDMINESGGGNSNNPIPCPPEIPRFRYFKLGLRGGAPMWSFGRGAKRIPAPPNAKPDEPKAKKESHLSKVSILKRKPPIASIGKVGSLVSSDYNDLDDSSTTPPVTPPLASTSRGSLSKKKNLELQAQKDSVIVMHSPEDNNKQLEIMDYDDDNNTVLSSEVSLSSVARNDDDLVEIETISQDLAEGLSSPLESDQIGDEFLLFPGNMVVDMSGEEHYSEKEEEETVDEEYTDQNMHIVIRSPTTSDDEFIMPCKVKQYNEDEQEDNPESPDQEEFGESSDMMASYDNEDTDIIISDQTTGVPEDSISTKEDFEELIDEGSRKNNISKQEVTAKHIQDFHRYTELFDYGKPDAQPVKKPVAKKFQPKVSLVRGVALPSKPNTEKIIITQNSNVLNTSQASKVTSIILTHNANVRRNIISVPKIVSTVSPAITIVSASTSQMASILPSKFTVPVISASAVRQLSNVKVIDKPSTSSLSISTRDNVLPKKIFEDDSVSPDSSNCDDEKSKDSFDDKVKSESPPREVKQFVKSDQQVISLKSKNYSDQSKKIEHLQIVNISAKDVVQRQRIPSPLISKASPVIIHNTPELKMTAQVIQESQTRMKITTTTDTEHYDESADDTKSVVISIPSPTPSQEQMLDSIAFQALENRRREYDSIEDVLDMIENIENITAEPPEILEENTLQNSDSNSNIETKTTETKELKLPTSESEAPATKSSIVPQLSPLSQPTELTTNMANASQQLRTLLSSLQTTSTSSPTNVESIAKGFGQKMSTSSSANQPIVASRVIGQQAGRQSPVITSVSTVIVPNFKQKITAATTAASRSSPVKVVSTSQQLTGSIITSTLNYIPNRTIGIQMVADQSKLPPASIVTTMQQINSITSSQESKKPSLTLTAMLQNQPAANMMTKSSADTITAASLLGSPISLPKTGFTTSLVQAQPSVVLSNTPPAPSQTSTATSSTKTTADSITAASLLGSSIKTSFAMQPSSTVGVVTSCVNKTPTSTTNLLHTQLTKVVRSKSVDDVKELAKIDENKQSVSSEIVDDSNSGCKSSTITTVACNKTEDSQNVLLKKLLQNTACASAQSSPPASTSTVTTSAANTISKVVNTQCSTSASVEQPPVSAPSNVTVQRSASRDELLSPPQDVQTMVVIKKEPPLVPLSQPSPVLNSNSNAHTPEVKKEFIDESSQHSEVSDHSRSDAPIKEELETMESAAEKMMLDKEELKKQKRRMYQQKRRQNQILNKELAQQQPKKRPRKNSKIDEDYDTYIDGVLAQLRQLPPIAVSEPVLNRNFGVVPLFGCGDLAKIGAKDYSTHLGELTGNYGYGELPGFTDFYSTKPYGDMDPLPEKPPSSTQRGFYDQEFPLIRFDADEHKKFDVFCREDSPDSILSSSSPECTREPEGKFVGLKLISDSEEDEEDDAKDSVSKGRMSPVVPVIKPVPIRLKPAGELYFKENLNENKENINSDSVHVMTKSKFDNKQSPPSNVSGHVTVTLTLTSSAAEDIMGVLRDLANILHIPAPTSYQIVERTASPPSQKLGLYRTKGKDGKEGAPIDIQSILNGATKFCKHCDVIILSNIIRRKVSDLPFLAKDSDLLSDGEELFFCSSACYMQFALMHRSPSISEDKAAEIINHLSQKDNLDSKQKLPADALDSNKSIAQKLSFNIKDAKREFEPMETNDAFAFFARTTANKQGNNFYDGAPFKSVPARVHRNDRYKLWTPGCLQPTQKHKTPTDKEIMELLYRMQITVTPPVMPEDTRKCLFCHGIGDGVADGPARLLNFDVDKWVHLNCGLWSDGVYETVNGALMNVESALQSGLLATCVHCQSIGATIKCFKTRCSSIYHLNCAVKDNCVFYKNKTVFCKVHAPKNEKDNELTTLSVSRRVYIERDENKQVAAVMHHSDSTDLLRVGSLIFLSVGQLLPHQLQNFHTPNHIYPIGYKIIRFYWSMRNLNKRCKYICTIREVSGKPEFRVMVQEPPEADVEFSDCTPKGAWQKILDNVASIRKENNCLHMFPKFATGEDLFGLTEPAIVRVLESMPGIETLSDYKFKYGRNPLLELPLAINPSGSARTEPRLRSQLHWKKAHTQRTTGGTSSIRPMFGPSLTGSISTPAQGEIACPYSKQFVHSKSSQYKKMKQEWRNNVYLARSKIQGLGLYAARDLEKHTMVIEYIGEIIRSELAECREKQYEARNRGIYMFRLDEERVVDATLCGGLARYINHSCNPNCVAETVEVDRDIRIIIFSKRRILRGEELAYDYKFDIEDDQNKISCMCGAPNCRKWMN

SEQ ID NO: 11651 - protein, 1347 aa, Phyllotreta cruciferae
MFSTMPAKQKTAAKVDDDEMLSEILGEIDSDTANTSAIKKPKISNYSALATNLSVKNYMRNLSQPVKKRAIEKKVQPSVPKPVINLNKKLPEPIQIQDTKNETIEPHEHIDKEKADADTSYFDDDLDETLLEEFSEDLDKTATESQITESETKVDDFPDDFDTTEIEEIEERINAASEQLINDIQAEVETEWQYINNTNESFKLATEDSIPDSPAVNTADTPFVKVEGNIVFRFFWWDAYVDPLYQQGTVFLFGKTYCETSKKYESCCVAVKNIERTIFVLPRPFELDENGKPTDKPVTFKTIHDEFNNKILKRLGIGSFKSRLIKKKYVFGGSVPAESDYLEVRYPATFPRIRCSQDGDLYNDDEYIEDDLGYKTFSKIFGIKTNFLELLFLERKIKGPCWIDITDPEMAANPMSFCKFEVNCLKPANLRITAFEKPLPPPPLVVATINMRNCFNRATSNHEIVMLSCLVQNCYDVNKPPPEPAFQQHFCVFSCPRGQVLPPNVFESLQNYKITKALKTDNEKAMLSCFINNFAPIDPDLIVGHNLQGYQATILADRLVKLNCVYSNRLGRLKKKTTQAKQLEKTLFLGRLVCDIKTSAKELIKSKSYDFDTLCQVVLKLKENQRVDLEPEDVFKMFKTSQDLLKLISFTMQDSGYIMKMMYNLNVVPLALQITNIAGNVMSKTLMGGRSERNEFLLLHAFHEKGYILPDKVYRKIESESKKKPTYSGGLVLEPKVGFYDKLILLMDFNSLYPSIIQEYNICFTTLPVMDSDENLVLPDSNLPAGILPTEIRKLVESRRQVKSLMKKPDLPKDLKLQYDIRQMALKLTANSMYGCLGFGHSRFYARNLAALITQKGREILVNTKDLIEKMCLDVVYGDTDSLMINTNILEYDQVFKVGVKIKQEVNKLYKQVELDIDGVFKYLLLLKKKKYAAVTLSKSPTGELITTKEYKGLDIVRRDWSQLSSETGKLVLEHLLSDQSSDEKVQNIYDYLAKIKSDLVEGKIPIPLLAITKQLNKAPHLYTDKNSMPHVQVALRYNKKSRDHFRMGDTVPYVICIDNTSNNPMQRAYHVDELKGNPELKIDYDYYLEQQIHPVISRICEPIEGLDSYQLAEFLGANLKRMKRPKPKGGNENIQGENVVKAEVKFKNAEKFSFVCYICKHQNVVSEPLVNNIPFLETCQNSDCKSKPIDYLPSVQNQLYLTIRSHITKYYKKVLTCEDPSCPSAPRRLPLQFLKKRPICNKCGNAVMYRVYTEFHLYNQLAYYRYMFDLSKLKNKPLMDGETESGYRALLDTVEKFMNQSEYSLINLSEVFSQLGWAATVEERVLEESGNGIHFNEEGSEDVYDE

SEQ ID NO: 11652 - protein, 489 aa, Phyllotreta cruciferae
MAAAAAAKIAEVRETTRVERIGAHSHIRGLGLDDSLEARHVSQGMVGQVSARRAVGIVLQMVRDGRIAGRAVLLAGQPGTGKTAIATALAHALGQDTPFTSMAGSEIYSLEMSKTEALTQAIRKSIGVRIKEESEIIEGEVVDLSIERPATGVGTKVGKLILKTTDMETVYDLGGKMIDSILKEKVQSGDVITIDKATGKITRLGRSFARARDYDATGQQTRFVQCPEGELQKRKEVVHTVTLHEIDVINSRTHGFLALFSGDTGEIKSEVREQINGKVAEWREEGKAEIIPGVLFIDEVHMLDIECFSFLNRALENEMSPIVIMATNRGITKIRGTTYKSPHGIPLDLLDRTIIVPTQPYDEKELKEILNIRCEEEDCQMSDNALVVLTRICKETSLRYGMQLIMTSSLIARKRKAHEVDVEDIKRAYQLFFDEGRSVQFLKEYQQEFMFNEIDEKDDILDVSIRCEACVRPIFSETHYKCMQCDDFF

SEQ ID NO: 11653 - protein, 371 aa, Phyllotreta cruciferae
MALRTYGDKPISFQLEENGEYYCVGSEVGNYLRLFRGSLYKKYPGMFRRSITNEERRRLIELGLSQHVLASSVSLLRAEEVEDIIEGNDEKYKAVSVHTSEPPMPREGKSKKNMQWVPSLPNSSHLDAVPQATPINRNRVAAKKVRTFPLCFDDTDPQINIENACQQELLVPIRLDMEIEGQKLRDTFTWNKNESLITPEQFAEVLCDDLDLNPLTFVPAIAQAIRQQLDAFPTEPPAIIEETCDQRVIIKLNIHVGNTSLVDQVEWDMSEKQNNPEEFALKLCAELGLGGEFVTAIAYSIRGQLSWHQRTYAFSEAPLPVVEVPFRNPSESDQWAPFLETLTDAEMEKKIRDQDRNTRRIRRLANTTPGW

SEQ ID NO: 11654 - protein, 207 aa, Phyllotreta cruciferae
MLCCCSDKEDYGKGPMAAIRKKLVIVGDGACGKTCLLIVFSKDQFPEVYVPTVFENYVADIEVDGKQVELALWDTAGQEDYDRLRPLSYPDTDVILMCFSVDSPDSLENIPEKWTPEVKHFCPNVPIILVGNKKDLRNDPTTINELKKMKQEPVKPQDGRSMAEKINAFAYLECSAKSKEGVREVFENATRAALQVKKKKKHRCVMF

SEQ ID NO: 11655 - protein, 1384 aa, Phyllotreta cruciferae
MNASTFNPRMDAAQNPVQKMELASRNVENSLLIDNNAPRLIDFMNINPQSGSTASGFADHDYPTLSGLSHIINSMTQIKCVSNVPIPSEIVDHFARVQCHCMMGLFSEINRAWLTVDSDIYVWTYEENTDLAYFDGISETIVCVGLVKPKPGVFHAFIKYLLILATSVDIVVLGVTFTERPGDNADEIQLIPDPVFILPTDGSTVTIINSTDDGRIFYGTKEGNLFEIAYQAESGWFGKRCKKINLSTSTLSFLVPSFINAALSEEDGITQISIDDSRHILYILTEKGSIEVCDLGDKGNSFSRISKISQNTLVNQAMNTVKTLDSQNFRPIVSISAIEASESVNLNLVAVSQTGVRFYMSVTSLSNQNPNQRPYTLTLAHVRLPSESVNLNLVAVSQTGVRFYMSVTSLSNQNPNQRPYTLTLAHVRLPPGYSANITVRPRAVHVSQYRDRNLILISTVNEKDVLWCMSSDLFPFGRGLTEAYTAINLDGPALAISEVRNGSPLQIKDLHEAPPLVVRQHAEPPKKYIVLTSHSIQIFIKLRPVDVLKQILKDSHGQDTEALKAFFTIQKEDQACATALILASLENEDNMDIAEFATRAFFLFGGEPKLAAPMNTFSGPSVFCPPVMSTPNIHQYQQQQQFQASPQYQHNFPHAISPGANAYELTSPFVFSPKHNGLYLYLSRILRPIWHRRTVDKLCLDGKIVTNHSTVTSEDCIFILNYITSLHNFLMRNTQLSTLSAGPGPGQNPQTFNNTTINMTRLNHTIQDVQLEERASLDALKTFVCHCCQILGLWRILCEHQFHTLIASLPETEQQILQNTTFKDLLLYRHDICSLLIATLVDSYLGDNASVDSISSKLREVCPLFYKTEDAAFSKAVEILKMTRTIQNNDEKEEMIQSALQICKSIGPTINITDICKEFANLKAYKAVTELCAHFGKKIDPDKIAESYYNAEDNSGDQEGYNYYQRRLEIYRHILNMLDQLYNEQNQTLVTSRDASYSVNQTILLDGVEQSQVGYVMKQVIKDVMETPDEIMHFALYDWLVFKNMTGDLINIQNPSLETYLKRTSTQNPNNIEAMNLLWKYYESCNNHAAAAKILNNLASRTGINVPLKERLSYLARAIMCMRSDKIGYAPYLGVFLRDLEDKMEVAKVQEQILDAIVNLQGQIPNAQEAISALNSGLYEISQLYENFAEPFKLLECQLAIIECAGYTDQVLIESIWQQILTEELRKTYGTGTDKVCQLLNKVKQLSKQYAQSANCFPLSYIVYELEIVNAKLRGDKQLVPCALESMNIPFENLINVYNSLNTISINDHFWQLEENEFHLSEATAALINCFLSHLEQYSSVEKRKITSLCQDAVVALLSNLYSKPNTEVLVNKLRNIQAKLSRI

SEQ ID NO: 11656 - protein, 1380 aa, Phyllotreta cruciferae
MSEFTLSYREVTPEQIDFENWKEITLTTGGTQSTLQDIKVAEKANGYCYKDSTKHCTRNRFIYWRINHNVLELVEHSLDINLTGNRIRYKFDTPILDGVSIHEVLDNIVILVPTVCSVHRLIFPHPNVFHAQDDLLGIYPDLTALSIFSKASIVDTRNPNSFYVFNNPSTANDQLPNLANSYFVPETGEAYFVLAFPSTELLLIRQSPDQVTCTELKGESLVPRFFAGLADKFRQRNSDSENVVSLLFYDLDEETYVLSLTQDAHLKFWSCSKGQCVAVIDVREKIRTNLKYRVQSAILKKAEDGNSSENILVLFLSFGNKCQFHILKPSIREQEITLNRLATLESPLNDLIDFAAQIDCLWSVWRSEEGETVVYNASFKSNRWTQVILETEPCEFKYCPIKYNDVKTLYLQHIFHPGRFPLHVINKTLSIYKMPTIASDAHLSVSALKQRVCLAVENDIQNLFNNGSDIDSVEVDEYVECAEWSWQKFYTYCVQYHTASRKPLGLMLLPSVSGAMLLKKSVFSFLRPVDSLEHMTLCTDLYREQFFNFSMLSEDLDTVDDVINVFKVIVYIEQQLKDVFMQSFETELLNLQSPDVVTEELLKRIYVEMDSDFFSHILHLIKDVNDLYKAIHKILELLRYENTLANPDNDINPSAMYYFNSLLGTSLVAQSFRQQAEIRFQICRNLLLLCNFLVMDRTLDWGVLEGVRSVCMPDIVVLTQASFVVLWLSGLTMFESDSIRDSSMSILNPLKLTPVYNLLPFTRCTSLLEVFISSSGVQDARKSFARVSCKDEALVHWHWSLLPYVNHIRHLIWPISGCTVLEEWLLSSGQHVWLQQYVRLLSNWCEWNACTRNFLLASSFLTTGEFYKAEELFETAAKGVFTDAFLKNRIKSVDDSNFRTTIHYYLKVIQLFELCNARNHVIYVANTALCVVKRDDPLAATLFSIKFKHHLALKHYQLAFDSLNSNPDGERRKDNLRDLVKTLLDEKKLNVLLNFTYGSMDEFFANIILTRARAADVTNNVFYDFLYSYQIKKGPPSFRLAASAMYEQAFRLSQKTTIEALEKQVKCYLAAKNVLHLCPPQHAWVVRPADPDEEDEQVIFQPLAGSNGEIRTFKIKKQIEVVDIETIGKELTFASAKLKLLQFNPTVSMNMYDPLELVISLNNSGMFKVAFEICSTFDLPYSLVFEALTKRCVLLTEAEDPNAWNWLVENDLQDLPVNRESAADVVWKFLQDCLEKYEEPNMSCLHNVVCKKIINMQIYLPHWLKASYKSRNPSELLRLLHASGRLEEAVELAKDYILSAMGYGKEEFGFKQPLAPTSPAFCLPVYAIQRLVDELNIQNSMNIEKPYVHEYDDLNVLFSKYLETAIRVSNQMCQVKCKAF

SEQ ID NO: 11657 - protein, 989 aa, Phyllotreta cruciferae
MEVSDKNLETLSRYLQETLNPDPNVRRPAEKFLEGVEVNQNYPLLLLNLVHKPEADMTIRVAGSVAFKNYIKRNWVVEEDQTDRIHESDRLAIKNLIVTLMLSSPESIQKQLSDAISIIGKTDFPLKWPELITEMVEKFSTGDFNVINGVLRTAHSLFKKYRYEFKSNELWTEIKYVLEKLAKPLTDLLVATINLSQTHANDVAALKIIYSSLVLICKVFYSLNFQDLPEFFEDNIQIWMTNFHTLLSVDVKSLQSQEDSEAGVLEQLKSQVCDNVALYAQKYDEEFQPYLPQFVTDVWSLLVATNLQPKYDLLVSNALQFLSSVAERSQYRNLFEDDNVLSSICEKVIIPNMEFRTSDEELFEDNPEEYTRRDIEGSDIDTRRRAACDLVNTLSQNFEQRIVEIFGRYLQVMLAKYTENPKEFWRSKDAALYLVTSLVSRGSTQKHGVTQTSQLVDITQFCQQHILPELERPDVNDLPVLKADAIKYVMTFRSVLPSDLVVSTLPQLIRHMPSESCVVHTYAACTLEKILMLKSNNQAIVTGDQLEPLASELLTNLFAVLQKPVSEENEYIMKALMRTFATLQDRIIPYLNVALPKMTEKLQMVAKNPSKPLFNHYLFECFSLAIKIICKVNPTAVTSFEDILFPIFQGILQQDIQEFIPYVFQILSLLMEHTPQGSLSDPYMQLLPCLLAPILWERPANISPLVRLLAAFATQAAPQIVLQDKVGGFLGVFQKLLASKSNDHEGFRLMQSLIQNLPTEALTPYHKQIFFLLFQRLSSSKTTKYVINLIVFFCLYMVKYSPNDLVALIDEIQGQMFGMVLEKLLIAELQKIAGDVERKIVACGITKLLCDCPAMYTGTYQKYWPQLLQALLAFFEMPRDETTFPDDHFIEVDDTPAYQATSAKLNFADGTKNDPLQGVSEPRQFLVQSLASLGATQPGRLPTYINQRKSAVADDTAGLFGQVRRSIGVNSSRLSSNIIYRKMMICETI

SEQ ID NO: 11658 - protein, 199 aa, Phyllotreta cruciferae
MAKVQLCNITVMDNPSPFLNPFQFEITFECIEELKEDLEWKMIYVGSAETEEHDQILDSVFVGPIPEGKHMFVFQADPPNVSRIPENDAIGVTVVLLTCSYKSQEFIRVGYFINNEYSDPEMRENLPSPPQFDKVIRNILASEPRVTRFKINWEESSGTQENGTTIAETPANQTTETSTSVEVPAFNENSNSWATMECS

SEQ ID NO: 11659 - protein, 312 aa, Phyllotreta cruciferae
MDQMLPSPGFSIPSIGTPLHQPEEDQLILPNAIQQQQSLPTTNSQVPPLAPMGGSTPTLGLGLGHAMSMPHTKYVTGFSLPISSMAPQTPQHTMMSPMVNVGGTGTTSSGVTPTLGPSTPSPMTPMTPHSADPGIVPQLQNIVSTVNLSCKLDLKKIALHARNAEYNPKRFAAVIMRIREPRTTALIFSSGKMVCTGAKSEEDSRLAARKYARIIQKLGFPAKFLDFKIQNMVGSCDVKFPIRLEGLVLTHSSFSSYEPELFPGLIYRMVKPRIVLLIFVSGKVVLTGAKVRQEIYEAFDNIYPILKSFKKQ

SEQ ID NO: 11660 - protein, 158 aa, Phyllotreta cruciferae
MAAMRSMSRLLFSRSLQTTVKRGYADQMSFTFAAGNQVFYDAKSIKQVDVPSFSGSFGILPAHVPTLAVLKPGVVTVYEDAGNVKKIFVSSGTVTVNDDSSVQILAEEAHPVENLDVSAARDLLNKAQSQLSSATTDQARAEAAIAIEVGEALVKAAE

SEQ ID NO: 11661 - protein, 323 aa, Phyllotreta cruciferae
MSGDGNQNEHFDTLFLSIAQHHPQGPTQLLDTFVNFLSRKTDFFTGGKEGEWEKLVLNTFKKYEKSSREQHAAELKEKQEQEARRKAKKEAESAKQAQITELTEEQAEKLQAELDAKKSPASVTPSNSSSGPSTSTTKIEEDEDESEKGKLLPNKGNGCDLDKYNWTQTLSDIELRVPLQCNFRAKQKDLTVNLTKKRLTCGLKGHPPIIDDDFQHEIKLEETNWVIEDGKSLLFSIEKVNKMNWWSKIVKNDPEISTKKINPEPSKLSDLDGETRGMVEKMMYDQRQKEMGLPTSDERKKQDVLKKFMEQHPEMDFSKCKFN

SEQ ID NO: 11662 - protein, 158 aa, Phyllotreta cruciferae
MQSPSGMVHGHPGASILQWSPDKKYSDRERWICVYPAYINSKKTIAQGRKINKEKCVENPTHQEIRDVLLAAGLKVGVENKLYSRERSKELLYRGRIRVQLKNDDGTLCNPNFPTRDSLMLHLGDMIPKLKSRQNKGSGDPQPTTTSSKGKGKGKGRR

SEQ ID NO: 11663 - protein, 733 aa, Phyllotreta cruciferae
MEEPEPTKRQKMPKVAKVKNKAPAEIQITAEQLLREAKERDLEILPPPPKQKISDPAELADYQLRRRKQFEDNIRKNRAVISNWIKYAQWEESQKEIQRSRSIWERALDVDHRNITIWLKYTEMEMRNRQVNHARNLWDRATVLLPRVNQFWYKYTYMEEMLENVAGARAVFERWMDWQPDEQAWQTYINFELRYKEIDRARQIYERFVITHPEVKHWIKYARFEENHGFIHSARQIYERAVQFYGDDHLDEKLYIAFAKFEENQKEHDRARVIYKYALDHIPKDETKELYKAYTIHEKKYGDRSGIEEVIMSKRKLQYEQEILQNPTNYDAWFDYLRLVEGEADLEITRETYERAIANIPPSKNKQYWRRYIYLWINYALFEELEAKDYERTRQVYKACLEILPHKTFTFSKIWLLYAQFEVRQKHLKAARKVLGMSIGMCPRDKLFRGYIELEIQLREFDRCRKLYEKFLEFGPENCVTWMKFAELETLLGDTDRARGIYELAINQPRLDMPELLWKAYIDFEISQEEPNNARQIYERLLERTSHVKVWLSYAKFELNNPSEEDFNIRLARRIFERANENLKNVPEKESRVLLLENWREFENNHGDEAHKEKVNAKMPKRIKKRQKVIDEDGVEQGWEEVFDYIFPEDEASRPNLKLLAAAKNWKKNTDEPEEDTENRTTLSSSSQRMKEKLLASVKNWKNNDKENSDSNNDECSNEDVVQITDSNNAVEN

SEQ ID NO: 11664 - protein, 476 aa, Phyllotreta cruciferae; identical to SEQ ID NO: 11553

SEQ ID NO: 11665 - protein, 306 aa, Phyllotreta cruciferae
MAATVGRICGVGLLKPNNLTTIGQISSYSTAKEWSRGKKALLGTLGLLAGGTGAVLVALDQSVKASDLELHPPKNIWSHSGIFSSLDHASVRRGYEVYKQVCAACHSMRFVAYRNLIGVTHTEAEAKAEAEDQMIEDGPNDEGNMFKRPGKLSDYFPSPYPNEEAARAANNGAYPPDLSYITSARHGGEDYIFALLTGYCEAPAGVIVREGQYYNPYFPGGAISMAQALYNETIEYDDGTPATASQLAKDVSTFLKWTAEPEHDDRKRMLIKVIGIFSFLLGITWYIKKVKFSSLKSRKIEFRPKK

SEQ ID NO: 11666 - protein, 564 aa, Phyllotreta cruciferae
MLALQQYSGSSDDEEDKEKSTINNDPSTPAEYSSKSKLAVCAAPEVLPTGLEEDQMHIDVDTKELAFNPKFDVLFAPALGPANPFKTQQQLVERNMLSGHIERAHVSEFQFENQRRTFTSYGYALDPSVTNDGKIKVVGSSEADDSSIKTVFEASKTRPLDKRKRKKNDDPSDVEGFLGPWGGFVDEQKVSKPTEEEQIELDEISSKKNKKGKPNEDKPLEEKSVLHIKDAVDYQGRSFLHAPQDVGVNLRSDTPPEKCFLPKAHIHTWTGHSKGIAAIRLFPRTAHLLLSAGMDCRIKIWEVYNERRCVRTYYGHRQAVRDINFNNSGKHFLSAGYDRYIKLWDTETGQVLSRFTSRKIPYCVKFNPDKNKQHLFVAGTSDKKIICWDTRSGDIVQEYDRHLGAVNSITFVDENRRFVTTSDDKSLRVWEWDIPVDMKYIADPTMHSMPSVTPAPNGKWLACQSMDNKVVIFSSMNRFKINRKKTFSGHMVAGYACSLDFSPDMSYLSSGDADGKVYIWDWKSTKLFKKWKAHDNVCISVLWHPHEPSKLISAGWDGLIKYWD

SEQ ID NO: 11667 - protein, 201 aa, Phyllotreta cruciferae
MVQKKPKKKVGKKVAAAPLAVKKVEPKKEVNPLFEKRPRNFGIGQDIQPPRDLSRFVKWPKYIRIQRQKAVLQKRLKVPPPINQFSQTIDKQTATQLFKVLEKYRPETALQKKNRLKAKAEAKVAKKEEAPAKRPNTLRAGTNTVTKLVEQKKAQLVVIAHDVDPIELVLFLPALCRKMGVPYCIVKGKARLGLLVRRKTC

SEQ ID NO: 11668 - protein, 333 aa, Phyllotreta cruciferae
MATIIKDITLQENIPQNILFEKHIDFIKEYGQKENNFEYAMTDYLRISGMYWGLTALELMNASPPHSIDEISDYIKQCQDPESGGISSCLNHDPHILHTLSAVQILCMYDNLKAIDVEGVVKYVKNLQLPDGSFTGDKWGEVDTRFSFCAVATLSLLDRMDAIDVNKAVDFVASCKNFDGGFGSRPLSESHAGLIYCCLGFLSVTNRLDIVDRDMLAWWLCERQLPSGGLNGRPEKLPDVCYSWWVLSSLTILGKLHCIDANALKKFILACQDTESGGFADRPGDIPDPFHTVFGISALSLLGNDTVQKVNPTYCMPQHVIDRLQLKPQILDV

SEQ ID NO: 11669 - protein, 888 aa, Phyllotreta cruciferae
MHQETLQLIQILEKTVSPDKNELEQASSFLEQASQTNLLGFIKTLSDILRHGGNSPVARMAAGLQLKNQLTSKDPTIKVGYQQRWLLFAEEVRDYIKKNVVGALGTETNRPSSAAQCVAYIAVTELPQGQWPDLISTLVSNICQGNSTEMQKEATLEAIGYICQEIESDVLVLQSNDILTAIVHGMRSSEPSNHVRLAATQALLNSLEFTKANFDLTTERNYIMEVVCEATQSPVSQIKVAALQCLVKIMSLYYQHMEPYMAPALFPITLEAMKSENDAVALQGIEFWSNVSDEEVDLSIEDTEATEAGRPPTRVSRHYAKGALQYIIPIILQKLTKQEELDDEDDWNPSKAAGVCLMLLATCCEDEIVPHVLPFIKENIKSDNWRFRDASLMAFGSILGGLEPNTLRPLVEQAMPTLIELMYDSSVIVRDTAAWTFGRICEIIPEAAINENYLKPLLESLITDLKAEPRVAANVCWAFSGLADAAYEAAAVNEETGAPDTYILSPYYEFIIQRLLETTDRADGAQANLRPAAYEALMEMVKNSPKDCYVTVQKTTMVILERLQQVLQMENHITSHNDRSQFNDLQSLLCATLQSVLRKVTPEDAPHISDAIMTAMLTMFNSNSCKNGGVQEDALMAVSTLVEVLGENFIKYMDAFKPFLYIGLKNHQEYQVCGTAVGLTGDIFRALKLKAMPYCDEIMTLLLENLSDQSVHRSVKPQILSVFGDIGLSIGSEFKKYLDVVLSTLAQASQAQVDRNDFDMIDYLNELREGVLDAYTGIIQGLKGDGPSPNPEVMVLEPHIPFIVQFIIVVAQDADHSDGTVAVAAGIVGDLCTAFGSSMVPLLDLASINDMLAQGRRSRVSRTKTLATWASKELRKLKMPPSAAAASW

SEQ ID NO: 11670 - protein, 500 aa, Phyllotreta cruciferae
METILEQQRRYHEEKERLIDAMVKEMLHKKNTYREAINSDHRQKYLLDRYMTSTERLIDLYEDKDGQRKAEVAALTGPNEFNEFYSRLKQIKDFYRRHPNEISVPMSVEFDEFAKARENPNEDMANFVEFTDEEGYGKYLDLHECYEKYINLKGIEKVDYITYLAMFDQLYDIPKERKTGEYRKYLLYLIEYLTWFVQRIRPLMDLDGDLLEQAEQAAAGWENGSVPGWPKETGSALANVGAHLDLSAFSSWEELASLGLDRLKSALMALGLKCGGTLEERAQRLFSTKGKGSLDPSLMTKNTKNRVTKEKEALRQKELATLEAQIYRLADLVSAQRAATKENVQRKQARTDGERDDSENEESEEESPDEADDDVPYNPKNLPLGWDGKPIPYWLYKLHGLNISYNCEICGNYVYKGPKAFQRHFAEWRHAHGMRCLGIPNTAHFANVTQIEDALALWEKLKVQKQSERWQPETEEEYEDSQGNVVNRKTYEDLKRQGLL

SEQ ID NO: 11671 - protein, 212 aa, Phyllotreta cruciferae; identical to SEQ ID NO: 11446

SEQ ID NO: 11672 - protein, 291 aa, Phyllotreta cruciferae
MNFGDLEFGFKISRKTIPLIVRETCLAIWNVIQPQEIPFPTKELWLEKSKEFYEITQFPNCIGSIDGKHIRIICPPNSGSEYFNYKKYFSIVLLAVADANYYFTAVDIGSFGREGDSTIFKKSNFGLRLKNNELDLPADNPLPVPDNVEQGSEVPYVLLGDEAFGLSKHVMRPYPSKGLSQEKRIYNYRHCRARRVVECSFGILSNKWRVLHSSMLIHPEFAVIVVQACCVLHSFVRRGDGYLFEDTLTCPLQDVQESAVVGGMSRGIDVREVFCQYFNGSGALSWQNKYV

SEQ ID NO: 11673 - protein, 4805 aa, Phyllotreta cruciferae
MLTTASPCLTCGSIGDIANLMFCSGCGAHYHGICVGLAQLPGVRSGWQCRKCRCCQVCRVVGDESKLMTCEQCDKIYHASCQRPVVTSIPKYGWKCRCCRVCGDCGARTPGAGLSSRWHAHYTVCDSCYQQRNKGFSCPICHKAYRAHAHREMVQCSSCKKFVHGTCDPEADVVTYNQKKEISIDYEYVCLHCKNSTARQITAKRASIDDPSDVSASHDSLYDDTSEFDLPSPDEFARNMGLGKGKPYSANKIAKKRLSFTVNPVGRPKGTGKVPPGKMGYMKRYRLTEFNRKRGPKAKMRGIFGVPGVGLQRPISDGKTDEEPGVENRLVLCSAKDKFTLTQDICVMCGAFGTDQEGCLISCVQCGQCYHPYCINVKVTKVILQKGWRCLDCTVCEGCGQRNDEGRLILCDDCDVSFHIYCMDPPLDYVPHGNWKCKWCAICQSCGTTDPGFNCTWMNSSTQCGPCASHVNCPSCNEPYGEGDLIIQCVQCERWLHGACDFIKCEEDAEKCAEEGYNCILCRPRDVPPPHMVPAAVTPKPPTPTKSPELGKSTSYYMDGVCLSEFGSNLIKSLALEYHGSRKKRKKIPTVQDKEAGIMATIESVVAGGNVIPTNMEDSAKLELVDIKDEPQELYKEGMMWTKEDGPPPEGFTIITMENGLNVLRRKRQRNLQKLGIGGFVVRMRGIRTGQDNDDVDSSIGQSGLNANDIVPSPADGDKPRRKTIRRKPKSKLAETFPAYLQEAFFGKDLMDTVDCKKEEVDCYSSDDEKTDKHFKSINLSQDEIIAIVASGKTEKLENNNKDSTKEVKPTVLKEEEEDNPEDLKDVLALPGDLLDTDLVNSIMEDEEELSKTTASLVALDSNLQHDTELTDTLSSSGNSKETKDELSDILGPHFNLDSIPNINSKDVEDIFKGVLTDESQESQESSSFSLQGNNMFSSNNAQQNVAQHPIINQAVRPKTLPTVNHNLNSPVSFPPPSPYHSEYSNSPQFSPAFTDSSCSWVGGNETPEIDSTNVTVTSTYNQRSSDKMKADESLGKSATISAVLYANINHPEWKKEYPNWPDRYKQIIKKWRTLSQEQKAPFLQHARDNRSQLRMKKAQQSQTVKETASTATSPNATKPLHQAGPALVTTLQAVTQQPAGAAAAPAPPVSEDQEKIALQQKSAREAEQERQWKQLQALRQQQTQQTQNILHEQRVQAIARVQRQISTDPAQQFINEQQSPLQVNTPQELSPSTTPAPSPRPFLGIKSPTFPVPSPVPQTGVRANTPSQSPHDISQPSTPDGNDHFIHSPTNPKPNFQPRLPNDPFAAQPATPRPQFGMARPPLQNFGGTVRNEQQDININRQLRELLQRQQVKKLDELLPGKAPPQRLWHANDQQEAGDASMTSAVQGAGAQGTDATFRQPLPPGVVKPRLAISSVNRPILGTVRVNQLDPRIQNLDPRMRLILQHQQQRLATGIQQQFIRFTSNVRPTTVEQYEQLLQRQGNNQNQIHAEEQQQGVARIPIAQASVIQRPHVAQAVVTGAAAVTTSTTESNSSEEGIPDNVTAELEKLEQETGTMVELQGVSDILGGLDDDDELLAEMGADFNILEYADPELEALTGGKTNILDLELEEEPVKKEKLASNANTCAPSQKPTPNVATTAISNSTSVTTPTEANAEPKIENTIQQSIPKSTPQQLQHPVSLPQQQNIPQHGAQVQVQSQQSQPHPPQQMPIQSTLHIQQIHQQMVHQVQQAAAQGRPMPPGSKMQTTDGFVGVVMANNAVQLQIPPNYQQRLLLLQQLQNQKLMRVGSTQPRAALQVAPNQMPVGMNPGARMPVSAPPPPPPPYPGPPPPYPGNANQHQQTGLRMGPGLLPMGHFHPSTLQGFPMHPHLQRRPLLLEEQPLLLEDLLEQEKREQEKLQNQPPNHEVTSSTGNETESALLSDQDFERLKADVFNSAPVSNISSTNQGNAAQTPQAWPQLQNRQAVVPAAASQHTMEVTTRVQMYNPNLIPAPPLPPENIATEQDKQAQLLYEQWLNHQNNSLVQQLRYYETEVQKLRKSKKSLNSKQRQLRKAGNQLTDADATELQRITAEQAILQKHLESSRKQNRQHGMLIQEYRNKHPAIKQRTVTDQIQSPLGHPASSPIQQSSASLSPMLSPSVSPMTQNSSPLNSPGPMVPSSPGHSAVQNILQSPNGANAAQMSPMQASPMQSSPRIGTPHSQSDESPGSAQSPSQVCLPPPMPRMTSPQHRRVVTSPVGMSQMRFINNNMLQQRVRMQSPIQNFQQKPGTPSPLNSPTSQQMNVNQQHQIQKQLQQQQQQQQQQTLLQQNLEGDPNAIHSQRTTQLLQHRNFIRQQVSQQQISPQTLTPQQHQLMLQQQKQLAQQQQQQIAQMNAARLQQQQQQQQQQQQQNNPPHSPMPPKSPMINQQIMSPHSMPQSPMQMPPKSPMVPFNPNQTNPNSPAARSPAFHQGMNQPTSPITHGHQPPSSPMPRSPMINQTHSPHNVRRPPSANSSPAMPDRPHSVENSSPRMYSIDQLVQESLANQNVNAQYNSYNSDMINESGGGNSNNPIPCPPEIPRFRYFKLGLRGGAPMWSFGRGAKRIPAPPNAKPDEPKAKKESHLSKVSILKRKPPIASIGKVGSLVSSDYNDLDDSSTTPPVTPPLASTSRGSLSKKKNLELQAQKDSVIVMHSPEDNNKQLEIMDYDDDNNTVLSSEVSLSSVARNDDDLVEIETISQDLAEGLSSPLESDQIGDEFLLFPGNMVVDMSGEEHYSEKEEEETVDEEYTDQNMHIVIRSPTTSDDEFIMPCKVKQYNEDEQEDNPESPDQEEFGESSDMMASYDNEDTDIIISDQTTGVPEDSISTKEDFEELIDEGSRKNNISKQEVTAKHIQDFHRYTELFDYGKPDAQPVKKPVAKKFQPKVSLVRGVALPSKPNTEKIIITQNSNVLNTSQASKVTSIILTHNANVRRNIISVPKIVSTVSPAITIVSASTSQMASILPSKFTVPVISASAVRQLSNVKVIDKPSTSSLSISTRDNVLPKKIFEDDSVSPDSSNCDDEKSKDSFDDKVKSESPPREVKQFVKSDQQVISLKSKNYSDQSKKIEHLQIVNISAKDVVQRQRIPSPLISKASPVIIHNTPELKMTAQVIQESQTRMKITTTTDTEHYDESADDTKSVVISIPSPTPSQEQMLDSIAFQALENRRREYDSIEDVLDMIENIENITAEPPEILEENTLQNSDSNSNIETKTTETKELKLPTSESEAPATKSSIVPQLSPLSQPTELTTNMANASQQLRTLLSSLQTTSTSSPTNVESIAKGFGQKMSTSSSANQPIVASRVIGQQAGRQSPVITSVSTVIVPNFKQKITAATTAASRSSPVKVVSTSQQLTGSIITSTLNYIPNRTIGIQMVADQSKLPPASIVTTMQQINSITSSQESKKPSLTLTAMLQNQPAANMMTKSSADTITAASLLGSPISLPKTGFTTSLVQAQPSVVLSNTPPAPSQTSTATSSTKTTADSITAASLLGSSIKTSFAMQPSSTVGVVTSCVNKTPTSTTNLLHTQLTKVVRSKSVDDVKELAKIDENKQSVSSEIVDDSNSGCKSSTITTVACNKTEDSQNVLLKKLLQNTACASAQSSPPASTSTVTTSAANTISKVVNTQCSTSASVEQPPVSAPSNVTVQRSASRDELLSPPQDVQTMVVIKKEPPLVPLSQPSPVLNSNSNAHTPEVKKEFIDESSQHSEVSDHSRSDAPIKEELETMESAAEKMMLDKEELKKQKRRMYQQKRRQNQILNKELAQQQPKKRPRKNSKIDEDYDTYIDGVLAQLRQLPPIAVSEPVLNRNFGVVPLFGCGDLAKIGAKDYSTHLGELTGNYGYGELPGFTDFYSTKPYGDMDPLPEKPPSSTQRGFYDQEFPLIRFDADEHKKFDVFCREDSPDSILSSSSPECTREPEGKFVGLKLISDSEEDEEDDAKDSVSKGRMSPVVPVIKPVPIRLKPAGELYFKENLNENKENINSDSVHVMTKSKFDNKQSPPSNVSGHVTVTLTLTSSAAEDIMGVLRDLANILHIPAPTSYQIVERTASPPSQKLGLYRTKGKDGKEGAPIDIQSILNGATKFCKHCDVIILSNIIRRKVSDLPFLAKDSDLLSDGEELFFCSSACYMQFALMHRSPSISEDKAAEIINHLSQKDNLDSKQKLPADALDSNKSIAQKLSFNIKDAKREFEPMETNDAFAFFARTTANKQGNNFYDGAPFKSVPARVHRNDRYKLWTPGCLQPTQKHKTPTDKEIMELLYRMQITVTPPVMPEDTRKCLFCHGIGDGVADGPARLLNFDVDKWVHLNCGLWSDGVYETVNGALMNVESALQSGLLATCVHCQSIGATIKCFKTRCSSIYHLNCAVKDNCVFYKNKTVFCKVHAPKNEKDNELTTLSVSRRVYIERDENKQVAAVMHHSDSTDLLRVGSLIFLSVGQLLPHQLQNFHTPNHIYPIGYKIIRFYWSMRNLNKRCKYICTIREVSGKPEFRVMVQEPPEADVEFSDCTPKGAWQKILDNVASIRKENNCLHMFPKFATGEDLFGLTEPAIVRVLESMPGIETLSDYKFKYGRNPLLELPLAINPSGSARTEPRLRSQLHWKKAHTQRTTGGTSSIRPMFGPSLTGSISTPAQGEIACPYSKQFVHSKSSQYKKMKQEWRNNVYLARSKIQGLGLYAARDLEKHTMVIEYIGEIIRSELAECREKQYEARNRGIYMFRLDEERVVDATLCGGLARYINHSCNPNCVAETVEVDRDIRIIIFSKRRILRGEELAYDYKFDIEDDQNKISCMCGAPNCRKWMN

SEQ ID NO: 11674 - protein, 684 aa, Phyllotreta striolata
MPREDILEGHKHKSHKSKKSRSSSRSERTQEKHKHSSSSKKKSSFHEDADRKKKKKRSKSSSSESESTSSESSGNSVELLKKLENERLRSAEQKKKEKELLKAAETAEEKRLRRLMKKEAKERRRKEKMGWDNEYLHYTNSDNPFGDGNLLTTFVWNKKLSKEGIKNVGHAEIEAINRLKQEENKRELEKVKKRRLERELERQKREEETQMMQRSKEAAQFEEWERQEDKFHLEQARLRSHIRIQDGRAKPIDLLAKYISAEEEVDAVEMHEPYTYLNGLQIKDLEDLVEDIKVYKELERGKNLDYWNDITVIVEDELQKLRKIEKQNDFDLGLNRREGIHQSVATDVTSVFKGKTAAQLAALERQIGSKISSKADGIDIGYWESLLSQLKAHMARARLRDRHQDSLRRKLQVLKAEQAITGVGQSHSETHSTDNEETTSEPKPSTSQDSLETMEESNEKSEDAAHAWLNECFSAYQAGGYSPKFLTPDDTEPGTIVVSEEDDLKRLEFARMQVTGQGTKIENVVTKEELLLQKEARKGMDGDEAQFSVEQALDNPVYLWSDKYRPRKPRYFNRVHTGFEWNKYNQTHYDMDNPPPKIVQGYKFNIFYPDLIDKSSTPEYYLTPSPENREFAILRFHAGPPYEDIAFKIVNREWEYSYKRGFRCQFHNNIFQLWFHFKRYRYRR

SEQ ID NO: 11675 - protein, 440 aa, Phyllotreta striolata
MDNLEANIMDKSMRSVFVGNIPYEATEEKLKDIFGEVGQVLSFKLVFDRETGKPKGYGFCEYRDQETALSAMRNLNGYEIGGRNLRVDNACTEKSRMEMQNLLNQPPVENPYGEPIQAEKAPEAISKAVASLPPEQMFELMRQMKSTIQNNPTEARQMLLQNPQLAYALLQAQVVMKIIDPHTAASLLHPVNQVPATLLAGDKNVGLQVPIGNQYREPPGPVQAPRQEYQPVPPPTAVVHPGHVQQQPVFTGQDVDLRSMGNVTDPRIRPMMVDQDMRQMPNVIQNPLPPTISESFSRDPRSATGGFPSDPRQARMDPRQKNIVPPAIQQPPSSVNPKLNQAGPVLPPPVRPAQNVIAQSTPTASAISSSLSSGSAGVGSAGANVMSPGIGGAGATDQEKAALIMQVLQLSDEQIAMLPPEQRNSILVLKEQIAKSAHVR

SEQ ID NO: 11676 - protein, 392 aa, Phyllotreta striolata
MAQMDAEREKSLQEYRKKLLEHKEVESRLKEMREQLKDLTKQYDKSENDLKALQSMGQIVGEVLKQLTEEKFIVKATNGPRYVVGCRRQLDKAKLKAGTRVALDMTTLTIMRYLPREVDPLVYNMSHEDPGDVTYSAIGGLSEQIRELREVIELPLMNPELFMRVGITPPKGCLLYGPPGTGKTLLARAVASQLDANFLKVVSSAIVDKYIGESARLIREMFNYAKDHQPCIIFMDEIDAIGGRRFSEGTSADREIQRTLMELLNQMDGFDSLGQVKMIMATNRPDTLDPALLRPGRLDRKIEIPLPNEQARLEILKIHALPIAKHGEIDYEAIVKLSDTFNGADLRNVCTEAGLFAIRAEREYVIQEDFMKAVRKVAENKKLESKLDYKPV

SEQ ID NO: 11677 - protein, 259 aa, Phyllotreta striolata
MARRYDTRTTIFSPEGRLYQVEYAMEAISHAGTCLGILANDGILLAAERRNTNKLLDEVFISEKIYKLNEDMVCSVAGITSDANVLTNELRLIGQRYLYQYGESIPCEQLVSWLCDVKQAYTQYGGKRPFGVSILYMGWDKHYGYQLYQSDPSGNYSGWKATCIGNNSSAAISSLKQEYKEGDMTLKDAKGLAVKVLAKTLDMAKLTSEKVEMATLTRRNDKTIINILNSKEVEELISEYEKSEAAAEATKKQEQKSAA

SEQ ID NO: 11678 - protein, 887 aa, Phyllotreta striolata
MSESKAEPIKVESKANDDKNKNELSDEDKQLQEELNLCVEKLQENDSKLYMPALQALGNHIRASTTSMTSVPKPLKFMKPHYDTMKTIFEKITEAPVKCLCADIISVLAMTMGEGRDCLKYRLLSDLDKIGEWGHEYVRHLAGEIAGEWGETDFLINTEVRDKLILLTKQIVPYNMAHNAEAEACDLLMEIERLDLLEQYVDENIYPRVCLYLTSCVPYVADPENTTLLQTALMLFRKFKQYPQALRLAMQLNDHSLIEEIFLNCPDTDVQKQLAFMLGRQQIYIEVPDTTPEYEDLIEIMANCHLNNHFLNLARELDIMDPKTPEDVYKSHLENSRPPFGGSQVDSARQNLAASFVNGFVNAAFGQDKLLMEDGNKWLYKNKEHGMLSATASLGLVLLWDVDGGLTPIDKYLYSSEDHIKSGALLACGIVNCGVRNECDPALALLSDYVLHSTNIMRIGAIVGLGLAYVGSNREAVLSLLTPVFSDPKSNMEVIGMSALACGMIAVGSGNLQVTTTIMQTLMEKSESELKDTYARFLPLGLGLCMLGKQEGIDSIIAALEVIPEPFKSMATTMVDICAYAGTGNVLKVQHLLHICSEHYDGSDSTDKSSKDKDKKDAAEKEKDLSSRQAVAVLGIALISMGEDIGSEMAFRTFGHLLRYCEPVIRRAVPLALGLISVSNPKLSILDTLSKFSHDSDAEVAHNAIFAMGLVGAGTNNARLAAMLRQLAQYHAKDPNNLFMVRIAQGLTHLGKGTLTLSPYHSDRQLMSPVAVAGLMATLVGFLDVKNIILGRSHYLLYTLAAAMQPRMLVTFDEDLNPLPVPVRVGLAVDVVGQAGKPKTITGFQTHTTPVLLAYGERAELATEEYLALTPIMEGFVILRKNPDFNA

SEQ ID NO: 11679 - protein, 469 aa, Phyllotreta striolata
FQTTKSRHIFLILPVPIWKICNMDSKEEKQASPENVKLKTEASEPEAPPAQATATGVIRRNFITPAGTIVETNEEQPPEPTTEEVVKTTSSNPSPAEQKTEPAEIVYTAEVLPQEQREQFADAKSYAVEMPAENFPNPSFTQDISYVNIEGTVVPVTISEMEHPGDYANLQTAQYNNGYTDGTQYLTNHQYQNMYIERSTVDNSPSATVLYRGDDPNLGASRFQANYDISSTQSQVNLLPASGETYYTSTSNWTPTSSGSYPQQYPSGTINVLQADSTQAFGTPYINATWSSNSMEDGRQSSQETGNRRNGVTCANCKTNNTTLWRRNNQGEPVCNACGLYYKLHNVNRPISMKKEGIQTRKRRPKNSSVGSPASAAGQVRMGLPTYQYSDMDVQQDQYQLPVNLYSQRPQVSYRHYGTENIGTLNAQPLQPIITHDDEQASVITSTSQQARFRTNVEEDEGSNPSMQS

SEQ ID NO: 11680 - protein, 730 aa, Phyllotreta striolata
MNTMALPGNGIFVVKGEISNLMAAMKRGPKWSSHSYQDDDVDALLRNFQELRDILHNVNDLGYVEPNTFLAPFLNVIRSEETTGPVTSLALSAVNKFLSYGLLDPVQTSIPQTIHTIADAVTHARFVGTDQSSDGVVLMRILQVLRTLTLSPEGSTLTNESLCEIMLSCFRICFETRLSELLRKTAEHYLKDMVQLIFMRLPQFSEDPKLSYVKRLRMQPGDLDQTRTKRKKYSKKENKEAVKVQPQETNVETTPQADIVDMQGTILRNNETASVTTPSSPNPNVDTDVTIDIPTDDSMKNSETSNLDDSGEKETDEPFQDYVNQRGIRFTPQFQQETNLSPYGLACVRELFRFLISLCNPLDKQNTDVMIHLGLGLLTVAFEISADNIGKYSTLLALVEDDLCRNLFALMNTDRLTIFAANLQVSFLLFESLRAHLKYQLECYLKKLMEIMRSESNKVSYEHKEIALDNLLQLWRVPGFHAELYVNYDCDMYCANLYEELTELLAERSISTVVGVYHQHLLSLDGLLIIIDGIGKRFDEAKDRTDTDEISSYIGENTRIKGCVKVPDKKVLAAKKAIKKWLPQGTEYFNQKPKKGVQFLQEHGVLKQELDVEEIARFLRENPALNKAMIGEYISNRGNLKILEAFVSTFDFTGIRIDEALRAFLETFRLPGEAPTISLILEHFAEHWHKSNGEPFADVDSAFTLAYAVIMLNVDQHNENAKKTNNSHVA

SEQ ID NO: 11681 - protein, 205 aa, Phyllotreta striolata; identical to SEQ ID NO: 11343

SEQ ID NO: 11682 - protein, 967 aa, Phyllotreta striolata
MDGKPDLEVVKSAVSTLYNNPDGGEKERASRWLLELQKSVHAWTVADELLRRCTNADDLQTRYFAAQTMRTKIHQSFHELPREVHESLRDSLLEHMGACAGVDEGAGAAIVTQLSLALADLALQMPDWRTPALDLIGRFSAGNNVWPLLEVLTVLPEELESRSVRLGENRRYEVLEDMKFCAPTVNEFLKHCSNLYGRGGSERLAAGDRPIDVKILRCFASWISVGAIGPSQLSEDRVVVDMAFDVLKTDIRPDEKESVTGQLHEAATDCICTLLLRLEDNNNHVALETHLFENIVNLEVAYHASVALEDQAKSTDYCRLFTELAESFLGKIVDDGGGGGGGDGGGGAKRRTVYAVKCLDLVLMCVGHHDYEVAEITFNLWHMLSEELYQKNNKELTELFKPYVERLITALCRHCQMEPDMEGLLEKGDEFKDFRMKVSDLIKDVVFIVGSSSCFRQMFINLQTSGVTWDASEAALFVMQAVAKNVLPTENEVVPKVVEAILNIPISAHVAVKYTSVLLLGELAEWIEKHPDALDPVLNFLVCCLRSGAEGGGVATAAASALQNVCTCCGAHMGRHVPILLQLLQQSDSFGVGNAAVVGLLKGVASVVSCGMGSGAETASAVRELCSMQLSPLCSLIENDVRPVKGTLTDPVLWLDRLSSVLRYVNVNIVEGEIHPCKPVIMEMWPILSRAFDAYHSDVRIMERCCRSVRFMLRCVARQLQDLLPSLVGQIVNIYCLYGHSCCLYVGSILVDEYAGDVTCVRGLLDMLNAFLEPTFRLLQEENGLKNHPDTVDDFFRLCARFVQRAPKAFLSGGSHLAPIIQCALLAATLDHKEANVSVMKFFYDLINQGLSGRGEPDFDERKALVRSLLNEYGQQLVSNLIHSCVFYLHSYMLSEVGDVFVQLLDFDRQITSEWLANGLELLPKQQNGGIMAAKPKQLNDVHASITRSNSSKSVTHALKDLTRLYR

SEQ ID NO: 11683 - protein, 485 aa, Phyllotreta striolata
PPPQRYQQPPPNQGMRQYGQQTFPPRPGYNPPPPNMQSSGGTMIQRPPGAPYSPMRGGPMPPQPVGKRPSDNRNPLQQKTGDYSHGTSKKKKKLADKILPQKVRDLVPESQAYMDLLAFERKLDSTIMRKRLDIQEALKRPMKQKRKLRIFISNTFYPAKEPQPEGPDGPGQEGTVASWELRVEGRLLEDSKNDPNKVKRKFSSFFKSLVIELDKELYGPDNHLVEWHRTLTTQETDGFQVKRPGDKNVRCTILLLLDYQPLQFKLDPRLARLLGVHTQTRPVIISALWQYIKTHRLQDGHEREYIICDKYLEQIFNCTRMKFAEIPQRLNPLLHPPDPIVINHVISVEGGAESKQTACYDIDVEVDDTLKTQMNNFLLSTASQQEIQGLDAKIHETVDTINQLKTNREFFLSFAKDPQQFIHKWIVSQTRDLKSMTDVVGNPEEERRSDFFYQPWAQEAVCRYFYTKVQQKRAELEQALGIRNN

SEQ ID NO: 11684 - protein, 144 aa, Phyllotreta striolata
MPKVRRSKKPPPEGWELIEPTLDELEQKMREAETESHEGKRKNESLWPIFKIHHQKSRYIFDLFYRRKAISRELYEYCLLENIADKNLIAKWKKQGYESLCCLRCIQARDTNFGTNCICRVPKSKLEEGRIVECVHCGCRGCSG

SEQ ID NO: 11685 - protein, 294 aa, Phyllotreta striolata
MPAATLGSNLHPNNEDCGIRDVWAHNLEDEFRTIRQIVQKYQYVAMDTEFPGVVARPIGEFRSSADYQYQMLRCNVDLLRIIQLGLTFLDDNGKTPGGVYTTWQFNFKFNLQEDMYAQDSIDLLQNSGIQFKKHEDEGIEPLEFAELLMSSGIVLMENIKWLSFHSGYDFGYLIKLLTDNNLPQDENEFFDLLKLYFPTIYDVKYLMKSCKNLKGGLQEVAEQLELERIGPQHQAGSDSLLTGMAFFKMKEMFFEDTIDDSKFSGHLYGLGTSFTVNGTTNNYGNDNGDTTNSS

SEQ ID NO: 11686 - protein, 403 aa, Phyllotreta striolata; identical to SEQ ID NO: 11347

SEQ ID NO: 11687 - protein, 533 aa, Phyllotreta striolata
MTAPAAGGDARGRTLAYKDKSKPADVRTSNINAAKAVCDAIRTSLGPRGMDKMIQAGNGEVTITNDGATILKQINVIHPAAKMLVELSRAQDIEAGDGTTSVVVIAGALLDAAEKLLQRGIHPTAISESFQRAAHLAVEILQEISTPVEITNRELLIKSASTSLNSKVVSQQSSLLGPLAVDAVLKIVEPGQEQACNLVDVKVIKQLGGTVEDTELIEGIVFSQRSANVSGPKRIEKAKIGFIQFCISPPKTDMDHNVIVSDYAAMDRVLKEERAYILNIVKQIKKAGCNVLLVQKSILRDAVSDLALHFLDKIKCMVIKDVEREDVEFVCKSLACRPIASLDHFTAENLVTADLVEEVGLGGNRMVKVTGIQNGGRTVTLLVRGSNKLVLEEAERSLHDALCVIRCLVRKKALIAGGGAPEIEVALKLAAMANKLEGIDAICTRAYATALEIIPFTLAENAGLNPIQTVTELRNRHAKGETSAGINVRKGTITDILEENVVQPLLVSTSALSFATETVRSILKIDDIVNTVT

SEQ ID NO: 11688 - protein, 409 aa, Phyllotreta striolata
MEAMDIVIPEKEEGSPSEAKQVLQDLDMEDLYTKYKKLQQTLEFLEVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVQYSDIGGMDMQKQEIREAVELPLTHFELYKQIGIDPPRGVLMYGPPGCGKTMLAKAVAHHTTAAFIRVVGSEFVQKYLGEGPRMVRDVFRLAKENSPAIIFIDEIDAIATKRFDAQTGADREVQRILLELLNQMDGFDQTTNVKVIMATNRADTLDPALLRPGRLDRKIEFPLPDRRQKRLIFSTITSKMNLSEEVDLEDYVARPDRISGADINAICQEAGMHAVRENRYIVLPKDFEKGYKNNIKKDESEHEFYK

SEQ ID NO: 11689 - protein, 162 aa, Phyllotreta striolata; identical to SEQ ID NO: 11350

SEQ ID NO: 11690 - protein, 345 aa, Phyllotreta striolata
MKAANNTKSVKMTSQKLNNVESVDKSEKGKIKTVVIMDDKASCKELDQWIEQLNDCKQLTENQVKTLCDKAKEILSKESNVQEVKCPVTVCGDVHGQFHDLMELFRIGGRSPDTNYLFMGDYVDRGYYSVETVTLLVALKVRYKERITILRGNHESRQITQVYGFYDECLRKYGNANVWKFFTDLFDYLPLTALVDSQIFCLHGGLSPSIDTLDHIRALDRLQEVPHEGPMCDLLWSDPDDRGGWGISPRGAGYTFGQDISETFNHSNGLTLVSRAHQLVMEGYNWCHDRNVVTIFSAPNYCYRCGNQAAIMELDDALKYSFLQFDPAPRRGEPHVTRRTPDYFL

SEQ ID NO: 11691 - protein, 216 aa, Phyllotreta striolata
IFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKEST

SEQ ID NO: 11692 - protein, 540 aa, Phyllotreta striolata
MMQPQILLLKEGTDSSQGKPQLISNINACQNIVDAIRTTLGPRGMDKLIVSNRGSATISNDGATILNLLDVVHPAAKTLVDIAKSQDAEVGDGTTSVVLLAGEFLKQLKSYIEEGVHPRIIIKAVRKATQICLEKINALAVKINKANPEEYRSLLEKCAATAMSSKLINKQKSFFSKMVVDAVLLLDELLPLNMIGIKKVQGGGLEDSMLVAGVAFKKTFSYAGFEMQPKIYKDCKIALLNIELELKAERDNAEIRLSSVKEYQKVVDAEWNILYNKLQKIYESGANVVLSKLPIGDVATQYFADRDMFCAGRVQEEDMKRTLKACGGSIMTTVNDLKDEVLGNCQLFEEKQIGGDRYNFFKGCPNAKTCTIILRGGAEQFLEETERSLHDAIMIVRRTIKNDSVVAGGGAIEMELSKLLRDYSRTIAGKEQLLIGAIAKALEIIPRQLCDNAGFDATNILNKLRQKHAQGNSWYGVDVNMEDIADNYETCVWEPAIIKINALTAAAEATCLILSVDETIKNQKSEAPPQMGGRGMGRPM

SEQ ID NO: 11693 - protein, 4648 aa, Phyllotreta striolata
MGDSLEASETAHETQNVALVDFTAFTNFILKAATVLLPEDDSQAEPANLIAAIDDKTNQECIKKFISDPQIVILYVQRNSSKDDDNVQPPEGEEEKEPVTYYISNEVHYSNSKMSSLVCIKRGPVIEADKSIRAQVRLMNFSEGSPYEILHDYVSRTVAPYFKSYVKESGRADRDGDKMAPAVEKTIAELEMGLLHLQQNIDIPEITLQVHPYVASLIKQCADEGRKPKVADFSDKVDDSNFLNQLQHGVNRWIKEIQKVTKLDRDPSSGTALQEISFWLNLERALHRIQEKRESMEVALTLDILKHGKRFHATVSFDTDTGLKQAIATVNDYNPLMKDFPINDLLAATELERIRAAVQLIFSHLRKVRSTKYPITRCLRLVEAISRDLGMQLLKVLGTRRLMHIPFDEFEKVMTQCFEVFSIWDDEYEKLQGLLRDIMKKKRDEHMKMVWRISPQHKKLQSRMDQMRKFRRQHEQLRTVIVRVLRPSVKESAAPVEGSDIEPPKPTFSLDAADANAIEEVNLAYENVKEVDCLDITKEGQDAWDAAVQRYEERIDRVETRITAHLRDQLGTAKNANEMFRIFSRFNALFVRPHIRGAIREYQTHLIQRVKDDIEALHEKFKVQYPQSNSAKISKVRDLPPVAGSIVWAKQIDHQLTTYLRRVEDVLGKGWENHIEGQKLKADGDSFRLKLNTQEIFDDWARNVQQRNLGVSGRIFTIEAVRSRSGRGNVLKLKVNFLPEIITLAKEVRNLKCLGFRVPLAIVNKAHQANQLYPFAISLIESIRTYEMTLEKIEDKASIIPLVAGMRKEVQLVLAEGIQLVWESYKLDLYVQRLSDLVVGFQERVEELVFVGEQLEVDVRSLETCPYSANTFADILSKIQHAVDDLSLKQFSNLHIWVLRLDEEVEKNLARRLQAGIEAWTETLSGQKKEIDHSMDTDAPAQPTHKPGGDPQIQTMIHEVRITNQTMYLFPSIEEARFLIMQQLFAWQAIVTCQQRLQSSRYQVGVDKPVVETYRNILTRLPAGAQPLINAYSAISSKIKEVQNYVNEWLTYQSLWDLQADNLYGKLGEDISKWMECLNDIKKTRTTFDTSDTRREFGPIVIDFAKVQSKVSLKYDSWHKETLSKFGSLLSNEMTSFHANVSKSRSDLELQSIEAASTSDAVSFITYVQQLKRNMKAWEKQVDIYKEGQRILERQRFQFPTNWLHVENLEGEWGAFNEIIKRKDSSIQTQVASLQQKIVSEDKAVESRTNDFLVDWERSKPVEGHLRPDDALSQLQLFESKFSRLKEERDNVAKAKEALDLQDPGGISTSEDKMQVVYEELQDLRGVWSELSRIWQQIDETREKPWLSIQPRKLRQQLDQLSTQLRELPARLRQYASYEYVKKTLQTYTKVNMLIVELKSDALKERHWKQLMKQLRVNWVLSDLTLGQVWDVNLQKNEAIVKDVILVAQGEMALEEFLKQVRESWQNYELDLINYQNKCKLIRGWDDLFNKVKEHINSVAAMKLSPYYKVFEEEASTWEEKLNRINALFDVWIDVQRRWVYLEGIFSGSADIKTLLPVETSRFQSISSDFLGLMKKVSKSPMVMDIVNILGVQRVLERLADLLGKIQKALGEYLERERTSFPRFYFVGDEDLLEIIGNSKNVARLQKHFKKMFAGVASILLNENNTIITGIASREGEEVVFKSPVSTVEHPKINEWLSLVEKEMRVTLASNLTQAVQDIKQFKDEIDSKSYMEWVDKYQAQIVVLAAQILWSEDVEAALVKMNSEPQKGVLEKVLQQVENTLNVLADSVLQEQPQLRRKKLEHLINEFVHKRTVTRRLIANGVCSNKAFEWLCEMRFYFDPRQTEVLKQLTIHMANARFYYGFEYLGVQDRLVQTPLTDRCYLTMTQALEARLGGSPFGPAGTGKTESVKALGNQLGRFVLVFNCDETFDFQAMGRIFVGLCQVGAWGCFDEFNRLEERMLSAVSQQIQTIQEALKSQKEAAAEGVATGSISVELVGKQVKVSPDMAIFITMNPGYAGRSNLPDNLKKLFRSLAMTTPDRQLIAEVMLFSQGFRQAEKLASKIVPFFRLCDEQLSNQSHYDFGLRALKSVLISAGNVKRDRIQRIKEGMTQRGETNIDEANIAENLPEQEILIQSVCETMVPKLVAEDIPLLFSLLNDVFPNVQYTRAEMEGLKDEIRKVCTEEYLVCGEGDERGSAWMEKVLQLYQISNLNHGLMMVGPSGSGKSSAWRVLLKALERFEGIEGVAHVIDPKAISKETLYGVLDPNTREWTDGLFTHILRKIIDNVRGEINKRQWIIFDGDVDPEWVENLNSVLDDNKLLTLPNGERLSLPPNIRVMFEVQDLKYATLATVSRCGMVWFSEDVLSTEMIFENYILRLKNIPLEESEEGFGKKSDLKDDMLSPTLQLQVDVVNLLQPFLGPDGLVVRCLEYAMEQEHIMDFTRLRALSSLFSMLNQAVRNVLQFNHMHPDFPLSSEALDKYIPKCLIYSILWSFAGDAKLKVRSELGDFIRSVTTVPLPSDRNLPIIDYEVTIEGEWSLWSNKVPQIEVETHKVATPDIVVPTLDTVRHESLLYTWLAEHKPIVLCGPPGSGKTMTLFSALRALPDMEVVGLNFSSATTPELLLKTFDHYCEYRKTPNGVILSPIQLGKWLVLFCDEINLPDMDNYGTQRVIMFLRQIVEQKGFYRASDQTWVSLERIQFVGACNPPTDPGRKPLSHRFLRHVPVVYVDYPGETSLKQIYGTFTRAMLRLAPGLKGYAEPLTNSMVEFYLSSQDRFTQDMQPHYVYSPREMTRWVRGICEAIRPLDNLSVEGLVRLWAHEALRLFQDRLVEDAERRWTNENIDAVALKHFPSANCEKALERPILYSNWLSKDYVPVGREQLREYVKARLKVFYEEELDVPLVLFDEVLDHVLRIDRIFRQPQGHLLLIGVSGAGKTTLSRFVAWMNGLSIFQIKVHNKYTADDFDEDLRSVLRRSGCKHEKIAFILDESNMLDSSFLERMNTLLANGEVPGLFEGDEYTTLMTQCKEGAQREGLMLDSNDELYKWFTQQVMRNLHVVFTMNPSTDGLKDRAATSPALFNRCVLNWFGDWSDGALFQVGKEFTNRLDLDKQSWKCPDFFPASCNRISATPNHREAVINACVYVHQTLHKANGRLTKRGSRTMAITPRHYLDFIHHLVKLYNEKRSDLEEQQLHLNVGLNKIAETVEQVEEMQKSLAVKSQELQAKNDAANAKLRQMVKDQQEAEKKKVQSQEIQQQLAQQTVHIKQKKSEVMADLEQVEPAVIEAQQAVKSIKKQQLVEIRTMSNPPALVKLALESICLLLGENASDWKSIRAVIMRDNFINSVVNFNTEDIGDDVREKMKSRYLSNPDYNIDKIYHASNACGPLVKWACAQVEYADMLKKVEPLREELNSLETQAETNQKRGEDVKVLIGQLEQSIASYKEEYAQLIAQAQAIKTDLENVQAKVDRSIALLKSLVIERERWEASSETFRSQMSTIIGDVLLSAAFIAYGGYFDQHYRQNLFSTWCQHLTLANIQYRADIARTEYLSNPDERLRWQANALPSDDLCTENAIMLKRFNRYPLIIDPSGQATEFIMNEFKDKKITKTSFLDDSFRKNLESALRFGNPLLVQDVENYDAILNPVLNRELRRTGGRVLITLGDQDIDLSPSFVIFLSTRDPTVEFPPDICSRVTFVNFTVTRSSLQSQCLNQVLKAERPDIDAKRSDLLKLQGEFHLRLRQLEKSLLQALNDAKGKILDDDSVITTLETLKQEAAEIGQKVEETDKVISEIETVSQQYLPLSQACSNTYFTMDSLNQVHFLYQYSLKMFLDVFATVLHNNVKLDGITDYQARLNVITSNLFSVVYERVARGMLHNDRMTFAILLCRIHLKGRPTEPNLDQEFNFFLRGKEGVFSSTNSAIVDGLNSDQQEAITRLSTKLPAFKKLPEQIKDMPEFGAWLQQSSPEQAVPQLWIEEKQLSAVGRGMYQMLVIQAFRPDRVIAAAQNFVAAVLGADFMYLAEKELDFATCVEKEIRSNVPALLCSVPGFDASGRVDDLAAELNKQISSIAIGSAEGFNQADRAINMACKTGRWVMLKNVHLAPQWLVQLEKKLHSLQPHANFRLFLTMEINPKLPFNLLRAGRIFVFEPPPGIRANLLRTFSTVPASRMMKAPNERARLYFLLAWFHAIVQERLRYCPLGWAKYYEFSESDLRVACDTLDTWIDATAMGRTNLPPEKVPWDALVTLLSQSIYGGKIDNDFDQRLLHSFLNKLFTPKSFDSDFALVANIDNGPGGNRHITMPDGTRRDHFLKWIESLADRQTPAWLGLPNNAEKVLLTTRGTDLIAKLLKMQQLEDDDELAYSLDDSSPSDPAAQIDGRPSWMKTLHNSAATWVNLLPTSLQTLRRTVDNIKDPLYRYFEREVNSASKLLTDVLHDLHDVLFICQGEKKQTNYHRTMLSELVRGIIPKNWHRYTIPKGCTVMQWITDFSQRVKQLQNVSQVVSSAGAKELQSFPVWLGGLLNPEAYITATRQCVAQANSWPLEELHLDVTITDSNDRNSIPHDCFAVVGIKLQGAQCRNNQLLLTSSIMIELPITLFRWVRVTGDEKLKEGKLSLPLYLNSTRTELLYTIELNIAAGQDPHSFYERGVAVLTSTSLN

SEQ ID NO: 11694 - protein, 890 aa, Phyllotreta striolata
MSRQGPSKRYESDSDSDSVDSAEEARRRDLQERDEFANRLKKRDEDRTRNVVQNFDKRTYEEAAKRLKLDHAGRDKVISELRKTSRWKYLEKRKDDKLQELEADIVDDEYLFEEEILTEREKKERQHKKELLQLAQEHEKARELERIQRYHMPRDLGKDSTADYIEVDELEKVPQSEQKKWEKDQMASAVFKFGAKDVKKTDDYELLLEDQIDFIQALQMPGSNEKKVPKMSDVQMKKLTIEETKKSLPIYPFKDDLIAAVKEYQVLIIKGETGSGKTTQIPQYLHEAGFTADGKKIGCTQPRRVAAMSVAARVAQEMDVKLGNEVGYAIRFEDCTSERTVIKYMTDGTLHREFLSEPDLQSYSVMIIDEAHERTLHTDILFGLVKDIARFRPDLKLLISSATLDVTKFSEFFDDAPVYQIPGRRFPVDIYYTKAPEADYVDACVVSILQIHVTQPLGDILVFLTGQDEIETCHELLQDRVRRLGSKVKELIILPLYANLPSDMQAKIFEPTPPGARKVILATNIAETSLTIDNIIYVIDPGFAKQNHFNSRTGMESLMVVPISKASANQRAGRAGRVAAGKCFRLYTAWSYKHELEECTVPEIQRINLGNAVLMLKALGINDLVHFDFLDPPPHETLVLALEQLYALGALNHHGELTKLGRRMAELPVDPMMAKMVLASEKYKCSEEIVTIGAMLSVNGAIFYRPKDKIIHADTARKNFYHMAGDHLSLLNVYNQWRDSDYSLQWCYENFIQHRSMKRARDVREQLVNLMQRVEIEMVSGIDETDNIRKAITSGYFYHIARFSKGGSYKTVKHNQSVTIHPNSALFETLPRWVLYHELVFTTKEFMRQVIEIESKWLLEVAPHYYKAKELEDSTNKKMPKTVGRSKMTD

SEQ ID NO: 11695 - protein, 456 aa, Phyllotreta striolata
MKVEEVKSTVKTQRISAHTHIKGLGLDEAGFAIPSAAGLVGQEQAREAAGVVVDMIKSKKMAGRAVLLAGPPGTGKTAIALAIAQELGNKVPFCPMVGSEVYSTEIKKTEVLMENFRRAIGLRIRETKEVYEGEVSELTPVETENPAGGYGKTVSHVVIGLRTAKGSKQLKLDPSIYEALQKEKVEVGDVIYIEATSGAVKRQGRSDAYATEFDLEAEEYVPLPKGDVHKKKEVVQDVTLHDLDAANAKPQGGQDVLSMMGQLLKPKKTEITDKLRKEINKIVDKYIDQGIAELVPGVLFIDEVHMLDIETFTYLHRALESAIAPIVIFATNRGRCLIRGTDDVFSPHGIPLDLLDRLLIIRTIPYNKSEMEQIIKLRAVTEGLEIEQEAISSLGEVGTKATLRYAVQLLTPSFLTAKINGRSNILQSDVEEIGTLFLDAKSSAKILTEQKDKFMT

SEQ ID NO: 11696 - protein, 733 aa, Phyllotreta striolata
MTSIIKVQALSGAKDESPPCYLLQVDDVRILLDCGWDEKFDMEFIKELKRHVHTIDAVLISYPDNNHLGALPYAVGKLGLNCPIYATIPVYKMGQMFMYDLYQSQYNMKEFCIFSLDDVDATFEKVVQLKYNQTVPLKGKGYGITVTPLPAGHMIGGTIWKIMKVGEEDIVYCNDFNHKKERHLNGCELKKLQRPSLLITDAFNATYQQARRRARDEKLMTNILQTLRNHGNVLIAVDTAGRVLELAHMLDQLWRNKESGLLAYSLAFLNNVSYNVVEFAKSQIEWMSDNLMRSFEGARNNPFQFKYLQLCHSLGELSKVPSPKVVLASSPDLESGFSRELFLQWCSNPNNSIILTTRTSPGTLARDLIDNGGGRNIDLIVERRVKLEGAELDDYERRQRSKYDKLEDEEADSDSDSDIEMSVTSKGKHDIVIKQEGKISTGFFKVTKKMYPMYPFKEDKIKSDEYGEIVKAEDYKLAEISAETEDNKENIVIKKEEEEITEITEQPTKCIILQRTVQVSCQVQYIDFEGRSDGESLMKILTQLKPRRVIVVHGTEENTSVIEKHCLDNLEARVFTPSRGEIIDATSETHIYQVRLTDALVSQLSFQKAKEAEVAWLGAHIVLRESQADAKRMNLDNEEMEVEEEDTRILTLEPLPESIPHDPVFINEVKLAEFKQVLGRNNINSEFSGGTLWCSNGSIAVRKVENGKIMLEGCISEDYYKVKELLYEQYAIL

SEQ ID NO: 11697 - protein, 762 aa, Phyllotreta striolata
MPPLEVTANTNNDESAPINPVVGIIYPPPEVRNIVDKTASFVARNGPEFEARIRQNELGNPKFNFLNGGDPYHAYYQHKVKDFREGKGHEPTPGLNQAIAKLSVSASAQQKQQEILKQVEQPFVPKDPPAEFEFIADPPSISALDLDIVKLTAQFVARNGRAFLTQLMNREQRNFQFDFLRPQHSLFQYFTKLLEQYTKVLIPPKSMEQRLRDEAKSAKAVLEQVKYRAEWLRYQEQQKAKEEEILERERVAYAQIDWHDFVVVETVDYQPFEIGNFPPPTTPEEVGARILIQERIEEGEDIEMQLESDEDDDPSNADDGLSAMQDKTKRKGGGDDNRLQDMEEDTSDEDNDDESGKTSTSSSLIQPPLPPVPDKVLVKKYDPKQAVKVSRPTVGDDYLVSPITGEKIPASKVQEHMRIGLLDPRWVEQRDKQMSDKMNQDMVYAAGSAIDASLKLLAERRTDIFGVGDEETAIGKKIGEEDVRKDEKVTWDGHTSSVEAATRAARANITLEEQIHQIHKVKGLLPDEEKEKIGPKNIGSKKINIQSVITTKPPNPSTQQSKQSISMMQTSAQPIMPVPAQPTMMAPQPSIMMMPAPPMPAIRPPPLMMAGGVAMGGYPVGPMPGGPPGPGMNMAPMKHPSDGPSEDEPSNKKLRNEDSLVPENVFLSRNPSQVSIKISVPLMPEKSEWRLKGQMVSWTLALTESVVNLKAKIQEETNMPPAKQKLFFDGMFFKDSNTLAYYNVTQGAVIQLQIKERGGRKK

SEQ ID NO: 11698 - protein, 324 aa, Phyllotreta striolata
MPSTEVTTTKVIVHPLVLLSVVDHFNRMGKIGNQKRVVGVLLGCWRAKGVLDVSNSFAVPFDEDDKDKSVWFLDHDYLENMYGMFKKVNARERVVGWYHTGPKLHQNDIAINELIRRYCPNSVLVIIDAKPKDLGLPTEAYQAVEEVHDDGSPTSKTFEHVPSEIGAEEAEEVGVEHLLRDIKDTTVGTLSQRITNQLLGLKGLHLQLRDIRDYLMQVGDTKLPINHQIIYQLQDIFNLLPDINQDAFNNSFYVKNNDQMLVVYLAALVRSIVALHNLINNKLTNRDAEEGKKEEKKDKDKDSKDKDKEKTDKEKEAKKDEKKK

SEQ ID NO: 11699 - protein, 550 aa, Phyllotreta striolata
MFGGGRAPILVLSQNTKRESGRKVQLENINAGKQIADVIRTCLGPQAMLKMLMDPMGGIVMTNDGNAILREITVQHPAAKSMIEIARTQDEEVGDGTTSVIVLAGEMLAAAEQFLEQQIHPTIIIRQYRQALEDMVQFLEGPLSVPLDRSDKNAIAEVVKGCIGTKFLSKWSDLAVNIALDAVNTVLLEENGRTEVDIKRYAKVEKIPGGSVEESRILRGVMLNKDVTHPKMKRHIKNPRIILLDCALEYKKGESQTNVEISTETDFTKLLELEEEHVKRQCDEIIALKPDVVFTEKGVSDIAQHFLLKAGITAIRRVRKSDNNRIARACGAVIVNRTEELQESDVGTGAGVFEIKKFGDEYFCFVDECKNPKACTILLRGASKDILNEIERNLQDALQVARNIILSPRLVPGGGAIEMAVAQRLMQKATHGPYRALAHALEIIPRTLAQNCGANTIRTLTALRAKHANHTDADKPCTWGIDGETGELVDMKVKGLWEPLSVKLQTYKTAVETAILLLRIDDIVSGSKKKGDKEVPTPSQMQQQEAQGAD

SEQ ID NO: 11700 - protein, 233 aa, Phyllotreta striolata
MMQTGIRPYYPDYSTIPVERQINPYADNGGSVVAIAGKDFVVIGADTRLSSGFSIYTRNQNKLFPLSETTVLGCSGCWCDTLTLTRILKSRMQMYHQEHNKNMSTTAAAQMLSTMLYYKRFFPYYISNILVGLDNEGKGCVYSYDPVGHCEKATYRAGGSAGALLQPLLDNQIGQKNLQKPSQEDLTQEKALSTLKDVFISAAERDIYTGDSVLIKIITKDGTKEETFDLRRD

SEQ ID NO: 11701 - protein, 299 aa, Phyllotreta striolata
MFQFGFNMFPDIPRPFNMTYKCYSVAMFPGNERQDVERGGKIIMPPSALEQLTRLNINYPMLFKLVNKKTSRTTHCGVLEFVADEGKVYLPLWMMHNLVLTEGDLVQMESVSLPVGTFSKFQPLNPDFLDITNPKAVLENCLRSFACLTTGDVIAVRYNQKAYELCVLETKPGNAISIIECDMNVEFAAPVGYKEPEHAKKEEEMSVDPADLMPEPSGFVAFRGAGNRLDGKKRKDSSSNDAPSVKPAYVRGIPDYDYQIGTLDFIRRTVMKPKEKDSSDDGDDFKAFSGTGFSLRNRN

SEQ ID NO: 11702 - protein, 540 aa, Phyllotreta striolata
MSALPGAIAFDEYGRPFIILRDQDKQKRLTGIDALKSHILAASQIAHTVRTSLGPKGLDKMMVSSDGEVTVTNDGATILKMMDVEHEVAKLLVQLSQSQDDEIGDGTTGVVVLAGALLEQAGALLDRGIHPIRIADGFELACQTAVDHLEKIAELFPVSAENTEPLVKVAMTTLGSKIINKCHRQMAEIAVNGVLAVADLEQKDVNFELIKVEGKVGGKLEDTTLVKGVVIDKTMSHPQMPKELKNVKLAILTCPFEPPKPKTKHKLDVTSVEDYKELRLYEQEKFKEIVGLVKKAGATLAICQWGFDDEANHLLLQQELPAIRWVGGPEIELIAIATGGRIVPRFEELSPEKLGSAGLVREISFGTTKDKMMVIEECSNSRAVTILVRGGNQMLVDEAKRSLHDALCVVRSLIQEPRVVYGGGAAEIACSLAVAAQADQLASLEQYAYRAFAEALESIPLALAENSGFSAIHTLGEIKAKQAASGDPALGVDCMNIGNINMREQHVTESLRSKRQQLLLATQLVKMILKIDDVRQPGSG

SEQ ID NO: 11703 - protein, 113 aa, Phyllotreta striolata; identical to SEQ ID NO: 11364

SEQ ID NO: 11704 - protein, 534 aa, Phyllotreta striolata
MVSLNPVRILKQEAEEERAELARLSSFVGAIAIGDLVRSTLGPKGMDKILVSSGRNSGMVEVTNDGATILKSVGVDNPAAKILVNMSKVQDDEVGDGTTSVTVLASELLKEAERLIEQKIHPQTIIAGWRKSVDIARKALLDASKDNSANLETFREDLMNIARTTLSSKILSQHKEHFAKLAVDAVLRLKGSGDLQAIQLIKKTGGTLQDSFLDEGFLLDKKPGVHQPKRVENAKILIANTPMDTDKIKVFGSHIKVDSMAKIAELESAEKDKMKDKVNKILKHNANVFINRQLIYNYPEQLFADAGVMAIEHADFDGIERLALVTGGEIVSTFDHPELVKLGTCDVIEQMMIGEDTLLRFSGVALGEACTIVIRGATQQIIDEADRSLHDALCVLAATVKESRIVFGGGCSETLMATAVAKAAVNTAGKEALAMDAFARALLQLPTIIADNAGYDSAQLISELKAAHNSGLNTMGLNMEKGELGDMRALGITESFVVKRQVLISAGEAAEMILRVDNIIRAAPRKRTEDRGMC

SEQ ID NO: 11705 - protein, 285 aa, Phyllotreta striolata
TMFRNQYDSDVTVWSPQGRLHQVEYAMEAVNLGSATVGLKSASHAVIIALKRASSELSAYQKKIIQIDDHIGITISGLTADARILSRYMRNECLNYKYSMDSYMPLNRLINILGIKMQHCTQRYDRRPFGVGLLVAGYDDDTGAHVYQTCPSANFYDCKAMSIGARSQSARTYLEKKLDELPSMALEDLIKHGLRALRDTLPPEVDLTTKNVSIGYVGKGTSFKILEEEETAPFLALIEGEERRGGSGGGGGAVEGAADPLRESGDEGGPPNRDPVPQVAMDTTE

SEQ ID NO: 11706 - protein, 848 aa, Phyllotreta striolata
MVLKPGNNQEPMEITFNDDDLPYEEEILRNPYSVKHWLRYIDHKKAAPNNEMNIIFERALKELPGSYKLWYNYLRTRRNQIKSKCITDPGFEEVNNAFERSLVFMHKMPRIWMDYCTFLTDQCKITRTRKVFDRALRALPVTQHNRIWPLYLKFVQKHDISETAVRVFRRYMKLCPENAEEYIDYLASVERLDEAAIITAKIVNDDNFVSQQGKSKHQLWNELCELISKNPEKVRSLNVDAIIRGGLRRYTDQLGHLWNSLANYYVRSGLFERARDIYEEAIQTVTTVRDFTQVFDAYAQFEELSLSKRMEEVAGKQNPSEDDDTELELRLARFEYLMERRLLLLNSVLLRQNPHNVQEWHKRVQLYEGKPHEIINTYTEAVQTVDPKLAVGKLHTLWVEFAKFYEGNDQIEEARLIFEKASQVPYVKVDDLATVWCEWTEMEIRNENYDEALKLMQRATVMPSRKVAYHDDTETVQSRLYKSLKVWSMYADLEESFGSFKSCKAIYDRIVELKIATPQIIINYGVFLEENNYFEEAFRAYEKGISLFKWPNVYDIWNTYLTKFLKRYGGGKLERARDLFEQCLDGCPPQFAKHLYLLYAKLEEEHGMARHAMAVYERSTKAVPENEMFDIFNIYIKRAAEIYGIPKTRQIYEKAIEVLPEDKTREMCLRFADMETKLGEIDRARAIYAHCSQICDPRVTAEFWQIWKEFEVRHGNEDTMREMLRIKRSVQAVYNTQVNMMSAQMLSSAGSSSGTVADLAPGVKDGMRLLEAKAAEMAGSAAQKGNIMFVRGETQGDNKDKVVNPDEIDIGSDDEEEEDEEEIPLEKQNVPSEVFGSLKKKGNDEDED

SEQ ID NO: 11707 - protein, 371 aa, Phyllotreta striolata
MANGPIAERNRDATIYVGGLDDKVSESLLWELFVQAGPLVNVHMPKDRVTMMHQGYGFVEFMGEEDADYAIKIMNMIKLYGKPIRVNKASAHQKNLDVGANIFIGNLDPEVDEKLLYDTFSAFGVILQTPKIMRDPETGNSKGFAFINFASFEASDASIEAMNGQYLCNRPISVSYAFKKDSKGERHGSAAERLLAAQNPLSQADRPHQLFADAPPIGMMPMSMAPPPPPLITGMMPPPPPTPGGMPPPPPPVPPPSSFPAGIPPPPLPPSQPPLPPGAPPAMAPVPGGAARPPPPPPWAGAAANVPMPPGPPAANAGGGFGGMLPPPPPPGGRPLPPNWRPPPPPPPNFGGARPPFPPRGPPPPPPTFEG

SEQ ID NO: 11708 - protein, 257 aa, Phyllotreta striolata
MGRVIRAQRKGAGSVFKSHTKRRKGAPKLRYLDFSERHGYIKGVVKDIIHDPGRGAPLALVHFRDPYKFQTRKEIFIAPEGMYTGQFLYCGKKANLQIGNVLPVGTMPEGTIVCNLEEKTGDRGRLARASGNYATVIAHNHDTKKTRVKLPSGAKKVIPSNNRAMVGIVAGGGRIDKPILKAGRAYHKYKVKRNCWPKVRGVAMNPVEHPHGGGNHQHIGKASTVKRGTSAGRKVGLIAARRTGRIRGGKVENKKED

SEQ ID NO: 11709 - protein, 136 aa, Phyllotreta striolata
MARTKQTARKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAIHAKRVTIMPKDIQLARRIRGERA

SEQ ID NO: 11710 - protein, 530 aa, Phyllotreta striolata
MAISLLNPKAEVARAAQALAVNITAAKGISEVMKTNLGPKGTMKMLVSGAGDIKITKDGNVLLHEMQIQHPTASLIARASTAQDDMTGDGTTSTVLVIGELLKQADIYIAEGLHPRTLTEGFDKARAKALEVLEKLKIPIEINKESLTDVCRTSLRTKLHQNLADLLTDVCVEAILAIKQSDKPVDLHMVELMEMQHKTETDTQLVKGLVLDHGARHPDMPKSLRNCYILTCNVSMEYEKSEVNSGFFYKTAEEREKLVLAERDFIEQRVKKVIELKKTLCKGNDKSFVVINQKGIDPMSLDMLAKEGIVALRRAKRRNMERLALACGGIAVNSFDDLQESHLGYAGHVYEHVLGENKYTFVEDCKVPQSVTILMKGPNKHTLLQIKDAVRDGLRAINNAIDDKALVPGGGALEVAVNKSLLAYKDEIKGKARLGVAAYAEAMLVIPKTLAVNSGFDAQDTIVKLQEEARLSSEPIGLDLTSGEPINPKDAGIYDNYVVKKQIINSCSIIASNLLLVDEIMRAGMSSLKG

SEQ ID NO: 11711 - protein, 1041 aa, Phyllotreta striolata
MSSAGIADSPIDPPAKKRKLDSKICSLDMANNEASGSSNAGEIDEGLYSRQLYVLGHDAMRRMATSDVLVSGLGGLGVEIAKNVILGGVKSVTLHDDALCTVRDLSSQFYLTDADVGKNRAEACCKHLSELNTYVPTKPYTGPLDEKIILKYRVVVLTNSTRAEQLRISEITHNNDIALIIADTKGLFAQVFCDFGKAFSVVDVNGEPPVSTMIADISNDTESVVTCIDDTRHGMEEGDYVTFSEILGMTELNNCKPIKIKVLGPYTFSIGDTTKFSKYVRGGIVTQVKMPKEVHFKPLKESLQNPEFVVTDFAKFDHPIQLHLAFSTLHKFVEKTGRLPKPWNKDDAAEFIALAKSLAVNGSTDNEVNTDILNVFSKCCSGDLNPINATIGGIVAQEVMKACSGKFYPIYQWLYFDAIECLPQDKDEITEELAAPVDSRYDGQIAVFGKDFQKRLGELKYFIVGAGAIGCELLKNFAMMGLGTQGGQITVTDMDLIEKSNLNRQFLFRPHNVQQPKSATAAKVIKKMNPDVNIVAHENRVGPETENVYNDEFFEVLDGVANALDNVDARIYMDRRCVYYRKPLLESGTLGTKGNTQVVVPFLSESYSSSQDPPEKSIPICTLKNFPNAIEHTLQWARDNFEGLFRQNAENASQYLRDPDFIERTVKLPGVQPLEVLESVKAALIDERPKDYDDCLAWARLHWEDQYANQIKQLLFNFPPDQLTSTGQLFWSGPKRCPDPLVFDINEDLHVDYVIAAANLKAQVYGIPTNRNRCYAKQVVTGIEVPAFVPKSGVKIAVTDSQMAMNGNNVDLDRINQIKQELPSMEELSDLKLTPLEFEKDDDANFHMDFIVAASNLRAANYKIPLADRHKSKLIAGKIIPAIATTTSVVAGLVCLELYKLARSIKSLTPFKNGFVNLALPFFGFSEPIAAPKMEYCGNQWTLWDRFEVQGEMTLAEFLEYFKEKHGLEITMLSQGVCMLYSFFMPKAKAQERLGLTMSEVVRRVSKKKIEPHVRALVFELCCNDADGEDVEVPYVKYNLY

SEQ ID NO: 11712 - protein, 342 aa, Phyllotreta striolata
LCQAKSGMGKTAVFVLATLQQLEPTENVVYVLVMCHTRELAFQISKEYERFSKYMSNIKVGVFFGGLPIQKDEEVLKNSCPHIVVGTPGRILALVRSKKLNLKHIKHFILDECDKMLELLDMRRDVQEIYRNTPHEKQVMMFSATLSKEIRPVCKKFMQDPMEVYVDDEAKLTLHGLQQHYVKLKENEKNKKLFELLDVLEFNQVVIFVKSVQRCVALAQLLTEQNFPAIGIHRGMEQKERLSRYEQFKDFQKRILVATNLFGRGMDIERVNIVFNYDMPEDSDTYLHRVARAGRFGTKGLAITFVSEEGDAKILNEVQDRFDVNITELPDEIDLSSYIEGR

SEQ ID NO: 11713 - protein, 523 aa, Phyllotreta striolata
PAGMEAGVNVICHHYTAKNNFSTTNSCFPNIRMKMGVETDVEMKNADSPAGMEAGDSKRDIDLQSVLEIREHARQIEKAVSSKENRFILRVLRCLPNTRRKLNGTVLRSLINQMYPVAERDVLFGLSEESTSDVDATQSRARSATKTPLPEVDAYIHLLLLVRLIDTNKLAEAERCSNIIMNKITSQNRRTIDHIAAKCYFYHSRVAELTDKLDSIRSFLHSRLRTATLRNDFEGQAVLINCLLRNYLHYSLYDQADKLVNKCVYPETASNNEWARYLYYLGRIKAARLEYSVAHKHLIQAMRKAPQNAAMGFRQTVQKLTIVVELLLGDIPERQVFRQANMRHSLAPYFQLTQAVRMGNLHRFGEVLENFGPQFRQDHTFTLILRLRHNVIKTAIRSIGLSYSRISPQDIAKKLGLDSAEDAEFIVAKAIRDGVIEAILDPQGGYMRSKESTDIYCTKEPQLAFHQRISFCLDLHNQSVKAMRYPPKAYGKELESAEERREREQQDLELAKEMAEEDDDGFP

SEQ ID NO: 11714 - protein, 562 aa, Phyllotreta striolata
MASSHQALPVSAILKSKSEVEDEPKKKSREDWRKAKELEEARKAGTAPAAVDEEGKDINPHIPQYISTAPWYYGTSGPTLKHQRPQDEKHKEYSDLNDWYKRGVDTSKIVTKYRKGACENCGALTHVRRDCMDRPRKVGAKYSGANIAPDEYIQKNLSLSFDGKRDRWSGYDPSEHKTVIEEFQKVEEAKRQLKSDKLNANEESDDEEKDEDKYVDEVDMPGTKVDSKQRITVRNLRIREDTAKYLRNLDPNSAYYDPKTRSMREDPNPGNDATYHGENFVRFSGDTTNHARAQLFAWEAHGKGVDVHLLAEPTKLELLKKEYEKKKDEVKSNIQGTVLEKYGGEEYLEAPPKSLLLAQTENYVEYSRSGKVIKGAEKEVIRSKYEEDVYINNHTSVWGSYWRGGQWGYRCCYSFIKNSYCLGEAGKSVNAQPMADIKTNDEPKEEQHHEDEVKEKNEAVDKESEESDSSSSSEEEKSKAKSKKKLKKKMKKQKKKQKKKDKEKEKEVKMSASIKDIDEDVIIDDRKRPYNSMFEAKKPTEEQMEEYYKKRRRDEDPMSQFM

SEQ ID NO: 11715 - protein, 208 aa, Phyllotreta striolata; identical to SEQ ID NO: 11604

SEQ ID NO: 11716 - protein, 311 aa, Phyllotreta striolata
MDRLLRLGGGMPGLTQAPPPSDAPVVDTAEQVYISSLALLKMLKHGRAGVPMEVMGLMLGEFVDDYTVRVIDVFAMPQTGTGVSVEAVDPVFQAKMLDMLRQTGRPEMVVGWYHSHPGFGCWLSGVDINTQQSFEALSERAVAVVVDPIQSVKGKVVIDAFRLINPNMMVLGQEPRQTTSNLGHLQKPSVQALIHGLNRHYYSISINYRKNELEQKMLLNLHKKSWMDGLTLADYSENCSVNEKTVADMLELAKNYNKALEEEEKMTPEQLAIKNVGKQDPKRHLEEKVDILMTNNIVQCLGAMLDTIVFK

SEQ ID NO: 11717 - protein, 386 aa, Phyllotreta striolata
MTVINKMEVDGPLKGEGFRSYYITKIEELQLIVAEKSQNLRRLQAQRNELNAKVRMLREELMLLQEQGSYVGEVVKPMDKKKVLVKVHPEGKFVVDIDKNIDINDVTPNCRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILKIHSRKMNLTRGINLRKIAELMPGASGAEVKGVCTEAGMYALRERRVHVTQEDFEMAVA

SEQ ID NO: 11718 - protein, 199 aa, Phyllotreta striolata
MVKLYCISILYKDTTYATWLKSAFDLQSFSFFQRGSVQEFMSFFCKTIVERTIPSSRQSVKEGEYMCHVYVRHDNLAGVVISDHEYPSRVSHTLITKILDEFAAKIPAVNWPTLQERDVTFPQLNTYLTKYQNPKEADAMTKIQEDLDETKIILHNTIQAVLERGEKLDDLVNKSEGLSIQSKAFYKTARKTNSCCSFT

SEQ ID NO: 11719 - protein, 242 aa, Phyllotreta striolata
MFLTRSEYDRGVNTFSPEGRLFQVEYAIEAIKLGSTAIGICTSEGVVLAVEKRITSPLMEPTTIEKIVEVDKHIGCAVSGLMADSRTMIDRARVECQNHWFVYNENITIESCAQGVSNLAIQFGDSDDDGAAMSRPFGVAILFAGIDEKGPQLYHMDPSGTFVQFDAKAIGSGSEGAQQSLQEVYHRSMTLEEATTAALTILKQVMEEKLNSSNVEVMTMTPKDLFHMFTKEQVEEVITKLS

SEQ ID NO: 11720 - protein, 385 aa, Phyllotreta striolata
MSEYWLISAPGDKTCQQTWDTMNNMTSKQNNLSANYKFQIPDLKVGTLDQLVGLSDDLGKLDGFVEQVTRKVAQYLGEVLEDQRDKLQENLQANNTDLPSYLTRFQWDIAKYPIKQSLRNIADIISKQVGQIDADLKTKSSAYNNLKGSLQNLEKKQTGSLLTRNLADLVKKEHFILDSEYLQTLLVIVPKAQFNEWNATYEKITDMIVPRSSELIIQDGDYGLFTVSLFKKVVEEFKLHAREKKFIVRDFTYNEEELAAGKNEITKLVTDKKKQYGPLVRWLKVNFSECFCAWIHVKALRVFVESVLRYGLPVNFQAILIHPNKKQAKRLRDVLNQLYGHLDSSAALSGPNVDSVDIPGLGFGQSEYYPYVYYKINVDMIESKV

SEQ ID NO: 11721 - protein, 557 aa, Phyllotreta striolata
MSILASPLSVAGSRTTGASVRTQNVMAASTIANVVKSSLGPVGLDKMLVDDIGDVTVTNDGATILRLLEVEHPAARVLVELAQLQDEEVGDGTTSVVIIAAELLKNADELVKQKIHPTSIISGYRLACKEACRYIQDHLTIPVEELGKESIVNVAKTSMSSKIIGADADFFSQMVVDAATAVKVTDAKGNSMYPIKAVNVLKAHGKSARESFLVAGYALNCTVASQAMPKRIVNAKIACLDFSLQKAKMKMGVQVLITDPGQLEGVRARELDITKERIQKILATGVNVVLLSGGIDDVCLKYFVERGAMAVRRVKKADLKRIAKATGASFVTSLSNMEGDETFDANMVGEAAEVVQERISDDELIVIKGPKARTAASIILRGPNDFYCDEMERSVHDALSVVKRVLESKSVVAGGGSVEAALSIYLENFATTLSSREQLAIAEFARSLLVIPKTLAVNAAQDATDLVAKLRAYQNSSQTKKDHAHLKYVGLDLLEGTVRDNRKAGVLEPTMSKVKSLKFATEAAITILRIDDMIKLDAEQKGGKSYHDAMDSGELYD

SEQ ID NO: 11722 - protein, 254 aa, Phyllotreta striolata
MFNSTHSAPPPFWSNGPAPGAFYNFPGTVAPVTNPITHTQSPVTTSTSIVSITYDKGVLIAGDLLASYGSLARYKNCPRVIEINPNIIMGAGGDYADFQYVKSFIEQKIIDEDCLDDGLKMKPKSLYCWLTRIMYQRRSKLDPFWNNLVVGGIQDGVPFLGTVDKLGTAYTDKVICTGYGAHIALPVLRDALDKKPNLNLNEAKQLIKKCMEVLFYRDARSYPKYQLGMIDVDEGVKIEGPISVEENWNIAYMT

SEQ ID NO: 11723 - protein, 701 aa, Phyllotreta striolata
MEFSKEPNFELLTAEDFSPEKYVKKLSQNYVGGSELQSLRRKIQGLSEETSSNLKKNVYENYIQFIETAKEISHLESEMYQLSHLLSEQKALLNCLSATSILEDVQPVNIDRDNKVNEKDLEEENKQKIAAILEKVEGCQELLKVPGRIFLYEGDLLEIEPTENTALKIVHVYLFTDSFMITTRNSNSRGLMKYIYESIYDLSSLAVVNVRDLGNVKHAFKLLIFPDTRVFQCSSNSNKKEWLDKFDQAKKTRLAQEQQKRESISEKSPTRVSFESPSYNPFDEVEEETSALHPEWFLEIPEELDVCVAQRHFEEALSLLQKAKEYLNQASSASGDKRDTVFTDIQRKVEQRQNNLTEVLMKELEVNPDKSLQGGLRAARRAVRLLNQLGRETQSCTLFLKLCSSMLRTQCKRVKREGSTTTYIKHLSSVVFTNMCHMSDEFLRAFPDSPACASAYVVWASNELLQFTTHFIKQVFMPQTSLSTVTECIVLVRHQCERLYVYGLDLCYQLDGALRSSLMKALKDARDKLIDSIKLRVLDDKWIPINLHSKSALSRCVQEYSQMGLTNVGSYVSGDTWLQLTASTLSFTKMFLNLLNDCMKLKTTELMYTIDETLYNVFEAQVRHNENALRSELNQDQRNFLTKNAEFLLVSLMQVVQKKYEEKVGYECPTLAKLQKEYVALQKGVSPASRSTKAKYASEFI

SEQ ID NO: 11724 - protein, 1080 aa, Phyllotreta striolata
SKDRRRSRSRSKDRRRSRSRSKDRRRSRSRSRDRRRSRSKDRYSRREKRHRSRSNEDYKRRRGDDSYSRDRRERGRSKESERRDRNRSRDDRKRERSRSRTRRRERSYEKKFKSEKDNPEFEDDPTPGKIYNGKVSNVVPFGCFVQLESLKRRWEGLVHISQLRAEGRVTNVSDVVSRGSKVKVKVLTITGQKVSLSMKDVCQTTGKDLNPLSHATAEREDKDRNPDRPTNNSTSVLRLPVSIDEGEENSRKRVTRISSPERWEIKQMISSGCIDKSELPEFDDETGLLPKDEDGEADIEIELVEDEPPFLQGHGRAVHDLSPVRIVKNPDGSLAQAAMMQSALAKERREQKMLQREQEVDSQPSGKNKNWIDPLPEDESKSMARGIGLQSQDLPEWKKHVIGGKKSSFGKKTNLTIIEQRQSLPIYKLKEELRKAVTENQILIVIGETGSGKTTQITQYLAEAGFTARGKIGCTQPRRVAAMSVAKRVAEEFGCRLGQEVGYTIRFEDCTSPETMIKYMTDGMLLRECLMDLDLKQYSVIMLDEAHERTIHTDVLFGLLKQAVMKRDELKLIVTSATLDAVKFSQYFFKAPIFTIPGRTFPVEVLYTKEPETDYLDASLITVMQIHLREPPGDILLFLTGQEEIDTACEILYERMKSLGPDVPELIILPVYSALPSEMQTRIFEPAPPGSRKVVIATNIAETSLTIDGIYYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLCKMLIMSVALQCSDEILTIVSMLSVQNVFYRPKDKQALADQKKAKFNQPEGDHLTLLAVYNSWKNNKFSNAWCYENFVQIRTLKRAQDVRKQLLGIMDRHKLDVVSAERNTVRVQKAICSGFFRNAGKKDPQEGYRTLVDSQVVYIHPSSALFNRQPEWVIYHELVQTTKEYMREVTTIDPKWLVEFAPAFFKFSDPTKLSKFKKNQRLEPLYNKYEEPNAWRISRVRRRRN

SEQ ID NO: 11725 - protein, 415 aa, Phyllotreta striolata
MASKRKNKKNILAKVNFPLYTVQMLTSRHVIVGGGGGTSKTGVENGFEIYEIFHDGHKFSAKEVTRHETGGNVVMNCCAFSDRKNSFLVAGQENYSQLYKVNTKLIEHEQVETVGDTASVRHRNTKPKEHVDNNKNIKKELAFDLNPLDCIQTDFKGTEPLCRVVRINHSGKILATGGTDGDVRLWKFPTMQPMSILKGHTKEIDDIDFSKFDNLIITLAKDGLAILWDAQTGKQKSKLTWKTPEGSKYLYKRCRFGVIEDQKNKCMLYMIANATNSKQASFLQQWIPEENTLKKFSEFNETLSALAVRDDGRFVAVGTMFSGSVSIHIAFSLQKLLVVVGAHSMFVTGLEFLSHENTNHSISSVAETAVLSISVDNQLCIHSVPYRRSIPLWIGIMVLVLVLFITFMLCAYMGL

SEQ ID NO: 11726 - protein, 413 aa, Phyllotreta striolata
MAGAMLFERAQSVPSQHDKLLKLNPADEDDEENIVNKEQDILNLGEKYKKEGKAKELAELIKATRPFLSLISKAKAAKLVRSLVDYFLDLEAGIGIEVQLCKECIEWAKEERRTFLRQSLEARLIALYFDTGMYTDALQLESTLLKELKKLDDKNLLVEVQLLESKTYHALSNLPKARAALTSARTTANAIYCPPKMQAALDLQSGVLHAADEKDFKTAYSYFYEAFEGFDSVESPKALTALKYMLLSKIMINSPEDVQQIVSGKLAIKYAGKDIEAMKAVAQAAHKRSLADFQLAVKQFKHELEDDVIVRAHLGTLYDNMLEQNLCRIIEPYSRVQVEYIAKTIKLPVLQVEKKLSQMILDAKFHGILDQGDGVLIVFEETPVDKTYEMALETIQSMSKVVDTLYQKAKKLS

SEQ ID NO: 11727 - protein, 578 aa, Phyllotreta striolata
MASRSKKSSTPSAQQRPASPLSPTRHSRLQEKAELQGLNDRLAGYIDKVRFLEAENNKLSREIQTTQETVTREVTNIKSMYDHELSDARKLLDDTHREKARLEIDVKRLIEENEELKAELAKKSKDLVVAENHARIYEARCNEYQLKSNQAAADAKKAIADAKELEKERDKLKKLLDAARKQLEEESLARVEVENHNQSLREELTFKDQIHQQELTETRTRRQVEISEIDGRLAQKYEAKLQEALQDLRDQYESQMANNRQEIELLYEQKIKNLQAAADRHQSTASGALDELRQVRTRIDTFTSRIQDLENQNNGLSARTRDLEKLLENERIRHAEDLAMVERELHRMREEMATQLQEYQDLMDIKVSLDLEIAAYRKLLEAEEARLNITPTGVEHEVHQRSSSQRRTPVRVGAKRKRALLEETQESSMSDYSVNSSSKGDIEVAAVDPEGQFVRLHNKSNQEVPLSGWQVIRRAGDEETFYKFHRTVKVEGNGTVTIWSSDLNKDHEPPSNLVMKGQKWVTGDNMITVVLNNNGEEVASSERVKRQISTSHLRHRELGDEELYHQQGDLQGEKCGLM

SEQ ID NO: 11728 - protein, 803 aa, Phyllotreta striolata
MADSKSPDDLATAILRKKDRPNRLLVEEAVNDDNSVVALSQAKMDELQLFRGDTVLLKGKRRKETVCIVLSDDSCSDEKIRMNRNVRNNLRVRLSDVVSIQPCPDVKYGKRIHVLPIDDTVEGLTGNLFEVYLKPYFLEAYRPIHKDDVFIVRGGMRAVEFKVVETDPAPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSEAALQQIREKMDLIDLEDDQIDAEVLNSLAVTMENFRYAMTKSSPSALRETVVEVPNVTWEDIGGLANVKKELQELVQYPVEHPDKFLKFGMQPSRGVLFYGPPGCGKTLLAKAIANECQANFISVKGPELLTMWFGESEANVRDIFDKARSAAPCVLFFDELDSIAKSRGGNVGDAGGAADRVINQILTEMDGMGAKKNVFIIGATNRPDIIDPAILRPGRLDQLIYIPLPDEKSREAIFKANLRKSPVAKDVDLTYIAKVTHGFSGADLTEICQRACKLAIRQSIETEIRRERERALNPNVAMDLDDDDPVPEITRAHFEEAMRFARRSVSDNDIRKYEMFAQTLQQSRGFGTNFRFPTAQGGPQAPGGTGGDQANFQDDPEDDLYS

SEQ ID NO: 11729 - protein, 274 aa, Phyllotreta striolata
MSDQFDCALDLMRRLPPQQIEKNLSDLIDLVPSLCEDLLSSVDQPLKIAKDKDSGKDFLLCDYNRDGDSYRSPWSNTYYPPLEDGSMPSERLRKLELDANLAFDQYREMYFEGGVSSVYFWDLDHGFAGVILIKKTGDGSRKIKGCWDSLHVVEVQEKGSGRNSHYKMTSTAMLWLQTNKQGSGTMNLGGSLTRQIELDAAVNDINPHIANIGRMVEDMENKIRNTLNEIYFSKTKDIVNSLRSVQPLTESRQQQALKQDLAAALQRRQNKSEN

SEQ ID NO: 11730 - protein, 884 aa, Phyllotreta striolata
MERPPRNEPPVEPVNGVVQPLVHPPPDSPGRVTNQLQFLQKTVLKAVWKDKFAWPFQQPVDAKKLNLPDYHRIIKQPMDLGTIKKRLENNYYWSGKECIQDFNTMFTNCYVYNQPGEDVVVMAQTLEKVFLTKVADMPKQEFVVDMPMKGAKGKKGRVSVGGGSTPSSSGPVPGAAAIPGAVRGRPPATVSSTSTTPIATTTGSSGLPLGTQAPATLPGSTATTTIAPANNNNSSLTPQQLVGTPVGSMHGTPGGAPLSNSLDPGGVMPGNVMPPAQPAKVKKGVKRKADTTTPATAYDYPTVLESKSAKISTRRESGRQIKKPARREIDLHVPQPAIHKPNEKLSESLKACNEILMELFSKKHSNYAWPFYQPVDAELLGLHDYHDIIKRPMDFGTVKEKMDNREYRTPQDFAADVRLIFSNCYKYNPSDHDVVAMARKLQDVFEVKFAKIPDEPVNRIGGGVNNLPIKSESSSSGSSSDSSSESEDSEEERRNKQLKVLEKELTALQEKMRKLVEESSRRKKEKKKNKMKKKPSGGGGGGGSSAAAAGALPNSSSGGGGGLGLRANKPAAASNAAAKRVKANNKTGAGRKKNAAQPPPMPFDSEDEDNAKPMSYDEKRQLSLDINKLPGDKLGRVVHIIQSREPSLRDSNPDEIEIDFETLKPSTLRELESYVASCLRKKPRKPYYKKVAGKSKDEQMAEKKQELEKRLIDVNDKIGNSKKAPKKDEANKVDPTGAGGPSGRLSSSSSSSDSDSSSSSLSSSSSDSSDSEAGGTTNRSTKKKVNKKSPNPSVDNTAITKPQQPTTAPPMSQTPANVNANVNVTVSANANAPPQSVPATTLTTTAAVNSNFPAPPPPPPQQQQAMAPNKQQHNVNVNANAPPQ

SEQ ID NO: 11731 - protein, 407 aa, Phyllotreta striolata
MSLSTARPLVSVYNEKSEEVKGSGVALPAVFKAPIRPDVVNFVHQQVSMNHRQPYSVSDKAGHQTSAESWGTGRAVARIPRVRGGGTHRSGQGAFGNMCRGGRMFAPTKPWRRWHRRVNINQRRYALASAVAASGVPALVMSKGHVVDQIPELPLVVSDKVQEMHKTKEAVQFLRRIKAWADIQKVYKSQRFRAGKGKMRNRRRIQRKGPLIVYYKDQGLRQAFRNIPGIDLISVQKLNLLKLAPGGHVGRFVIWTESAFQRLDKLFGTWKNPSTEKKGYNLPQPKMSNTDLSRLLKADEIKAVLKTPQKKVVRRVRRLNPLTNTKAMLKLNPYAAVLKREAILKNQKRQLQRDEALAKKRGITLTPDNAVIRTRKLQERRRAQILKDKKSKPKKAAKAPAKPAGKK

SEQ ID NO: 11732 - protein, 1498 aa, Phyllotreta striolata
MQLRDVPITPVTDDSTELEDEAEWIYRQAFCNKAISNVDAHLSAEAREKMKKGSQTVGKIKKALDFMRNQQLEVPFIAFYRKEYVQPELNINDLWKVYKYDAKWCQLKSRKENLLKLFDKMRHYQLDQLIKNPDAPIPDNVRVMKDSDIERLKNVQTAEELNDVHNHFILYYSGDLPAMHAAWRIKEKEQRRYEKRQKRLKQIAEAEDGAEIPDEPEDDDDDEPETETLKYANRSGSYALCSKAGLDPLAKKFGLSPEQFAENLRDNYQRHEVDQEPVEPSEVAREFISPKFSTVDEVLQASKYMVALQIAREPLVRKCVREVYFERARINVYPTKKGQKVIDESHNCYSMKYLKNKPVRDLNGDQFLKLCLAEEENLLTITINDNIEGNTSNSYIEEVKQLYIKDEFSKNVQDWNALRMECVERALTKSVLPDLRTELKRTLLSEAKEFVLKACCRKLYNSIKIAPYSITFPDEDEDEWDTSKGVRVMGLAYVPEYTVSAFACIAAPDGDITDYLRLPHILKRKNSFRTEEKLMKEGDLQVLKNFIFSKKPHVIAIGGESREALMIADDLKALINELVESDQFPEIKVEIIDNELAKIYANSNKGQSDFRDYPELLRQAISLARKMQDPLIEYSQLCNGDEEILSLRFHPLQEQIGKEELIEALCLEFVNRTNEVGVDINLAVQQAHKSSLVQFVCGLGPRKGQALLKVLKQTNQRLENRTQLVTACHMGPKVFINCSGFIKIDTNSLGDSTEAYVEILDGSRVHPETYEWARKMAVDALEYDDDEGANPAGALEEILETPERLKDLDLDAFAEELERQGFGNKSITLYDIRAELNCRYKDLRQPFHSANPEEMFDMLTKETPETFYIGKLVTASVIGIARKKPKPDQLDQANPVRNDETGLWQCPFCLKNDFPELSDVWNHFDAGACPGQATGVKLRLDNGIMGYIYIKNISDKPVSNPEERVGVGQLISCRIIKIDVERFSVDCTSKSSDLLDKNHEWRPPRDPHYDTEREEKDNRTEAEKKKEKQRLTYIKRVIVHPAFHNISYAEAEKCMVNMDQGEVIIRPSSKGADHLTITWKVADKIYQHIDIREEGKTNAFSLGKSLLIGNEEFEDLDEIIARHVTPMAAHARDLLYFRYYKDFEGGHKDKADEYLKDEKKKNASKIHYVVSAAKHIPGKFLLSYLPRNKVRHEYITVTPEGFRFRQQMFDSITSLFKWFKEHFREPPPGGMTPGTPRMSTGRTPYDMSTEAIQRVAQNLPSDMVQALSAATNQTPHYPHTPGGYGGNYINTPYTPSGQTPYMTPFQTPHAQQTPRYGQQTPSQPSLSNPFLHPGAVTPSQRTPSYRNLPTQSPMIPQSPVPSPGSQSSYSSHMSHHTRASYGDSLRFQPPESPRNYPSSRGSYPDGRYGGSESMDWQKAAEAWASRSKSTPRSEGRGTPRSSGHRTPRNYDNMSESDRSRMKHMSSKSPKSVRSTPRTNSSPRSMSLGDATPLYDENI

SEQ ID NO: 11733 - protein, 731 aa, Phyllotreta striolata
MPEVDNSETRSPRRKRRRSKSGERKEEKSSKRKSSRKRSSDDDYNERDYPRYYGEDRPNSDSYWNKYPRRDNMKVGRRYYDHPDHEKNRDRDASNEKSRDRDRESTRGKEYSRKEENEDKSVIKPRERKVVDMLTSRTGGAYIPPAKLRLMQESITDKSSAAYQRIAWEALKKSVHGYINKINTSNIGIIAREILHENIVRGRGLLCKSIIQAQAASPTFTNVYAALVAVINSKFPNIGELLLKRLVLQFKRGYKQNNKSICISATTFVAHLVNQRVAHEILALEILTLLVETPTDDSVEVAISFLKECGQKLTEVSSKGITAIFEMLRNILHEGQLEKRIQYMIEVMFQIRKDGFKDHAAVTEELDLVEEEDQFTHLIMLDDVKEVNAEDILNVFKFDEHYEENEGKYKTLSKEILGSDSESDSGSEGSGEESEGEDEEEEVKDAGKIIDNTETNLIALRRTIYLTIQSSLDFEECAHKLLKMELKPGQEIELCHMFLDCCAEQRTYEKFYGLLAQRFCQINKIYIEPFQQIFQDTYSTTHRLDTNRLRNVSKFFAHLLFTDAIGWEVFEIMKLNEEDTNSSSRIFIKILFQELAEYMGLGKLNARLKDETLQQHFAGLFPRDNPKNTRFSINFFTSIGLGGLTDELREHLKNVPKIMETKTAAVKEESDSSSSSSSSSSSSSSSSSEEESSDDSSGDSSSEDEKQKSKKKKKKRDSETKPSKSDAKSNR

SEQ ID NO: 11734 - protein, 595 aa, Phyllotreta striolata
MALKNQVGQKIMNEVIKHKPSKKNGPAVTQPHNAAGVDWRILVVDQLAMRMVSACCKMHDISAEGITLVEDIMKKREPLATMEAVYLITPSEKSVHALMNDFESPRPMYRGAHVFFTEACPDELFNKLSKSHAAKYIKTLKEINIAFIPTESQVFSLDSPDTFQCSYDPSFAAARNANMERMAEQIATLCATLGEYPHVRYRSDWERNVELAQLIQQKLDAYKADEPTMGEGPEKARSQLLILDRGFDCVSPLLHELTFQAMAYDLLPIENDVYKYEASAGVQKEVLLDENDELWVELRHQHIAVVSQSVTKNLKKFTDSKRMTQSDKQSMKDLSTMIKKMPQYQKELSKYATHLHLAEDCMKAYQGYIDKLCKVEQDLAMGTDAEGEKIKDHMRNIVPILLDTKITNEYDKMRIIALYAMTKNGITEENLTKLATHAQIKDKQTIANLQLLGVNVINDGGPRKKLYTVPRKERITEQTYQMSRWTPVIKDIMEDCIEDKLDQKHFPYLSGRAQTTGYHAAPSSARYGQWHKDRGQQAVKNVPRLLVFVVGGISFSEIRCAYEVTNAQKNWEVIIGSSHILTPEGFLSDLATLAG

SEQ ID NO: 11735 - protein, 712 aa, Phyllotreta striolata
MMQQYMKELEQEPFDAEEFVERLAWRTLAESKSEGEENEINPVLLHESFVQAIKDLNLLHERQQKKCEKLEVAVREDEATFFQEVYNLLEQNKQAMETFQELDGKINHVATKVLHLGDQLDSVNGPRSRVVDALSLMTHLREFLSNEPVSSTIFTNQEYIDEAADVIQKLYLISQELPPKFESIKRKIERKYSDIEKALIEEFVGAMDNENLTRMKEIALVLSQFKGYSQCVDAYIDHSQVGCLSSKDVFYNFLKLCKYNDEIIRKVFKNPEQVMAKFVLNIYQLKLVEYIDQKLNSKLGTYSYLQTLYELYSKTNNLSSELTVFHMGNDKNYLTKLTTNIFNKYINDYISMELKCLKDRCSTSLQKYYDSKSHQKKQIQSGGFQDLRRDLQAVIGTRANINIAQIENYGGETFVSEELAIMILQDTKQAFQRCLLLSKGSERASNATQILDRLINSLLIEHVDYAVELGLQAVPVVEGVRNPPVLYFFNVVHQSNNITHLVEKQFMDLVVPLVENTPKYSDCVQKKKFVLEDIERKINTGLDRCLSAILNWVKLYLQSEQKKSDFKPESDDFDTVASPACKNVLNYVNSIIKEIKTNLDGNNVTAILQELGIRLHRVVYEHMLQYQYNTAGAMVAICDLNEYRSCTKQLGPLVAELFDTLHALCNLLLVKPENLQQVCSEDSLAKLDGAILHSFIQLRSDFKVQKQTILKV

SEQ ID NO: 11736 - protein, 246 aa, Phyllotreta striolata
DRRERLRQLALETIDLQKDPYFMKNHLGSYECKLCLTLHNNEGSYLAHTQGKKHQANLARRAAKEAKDAPTSLQPEKPRVEPKKFVKIGRPGYRVTKQRDPETGQQSLLFQIDYPEISDLVLPRHRFMSAYEQKIEPPDRKWQYLLFAAEPYETIAFKVPSREVEKTDNKFWTHWNRDTKQFFLQFAFKNENKRSVNSVIQRHSIVGGVPPPPMLPVPPPPRPPMFNPIPPPPPMMRAVLPVPPPN

SEQ ID NO: 11737 - protein, 133 aa, Phyllotreta striolata; identical to SEQ ID NO: 11398

SEQ ID NO: 11738 - protein, 442 aa, Phyllotreta striolata
MATNLSRTSLLRIINARGYAALPHPLSGFPNAEVKSAVLPNKTVIAAVDNNASLTRVSIVFRAGSRNEDPENLGVAHVLRTAAGLSTKNCSQFAIIRNIQQVGANLTATSDRETICYTLEGTPEAVECALPFLTEVATQQEFRPWEVSDLSSRLQLDIATRPLQLRAIDLLHNAAFRGRGLGNSLFIPKTQIGKISSETLQHYVCSNFKSGRMAVVGSGISQKELTSFANSLKIENGDGDNTPSPYKGGELRSNKGGQLAFIAVAGEGAALKNSKEALAFAVLQGALGGGPQVKHGITDSGVFRKALGNSPDVSSVAINASYSDTGLFGLLLAVPTKSARSALETAVKVLKSGTVSDEDVTRGKNQLKASILFSAESGADIVRTIGQEAILTQKVTSTSALLAQVDSVSTSDVTNALKKAGQKLSLASVGNLAGVPFLDELK

SEQ ID NO: 11739 - protein, 110 aa, Phyllotreta striolata
MRRAHAGNYYEPLPQNSNEIEDENDRMTNELQEKIGALKSLTIDIGNEVKYQDRMLRDVDDDLEKTGGFLGTTMNKVLRLSKGGHNYIIVYLFLFSIVVFFILYFVIKFR

SEQ ID NO: 11740 - protein, 496 aa, Phyllotreta striolata
MSYPSTLNAKQAAQEHVLAVSRDFVSQPRLTYKTVSGVNGPLVILEDVKFPKFNEIVQLKLADGSLRSGQVLEVSGSKAVVQVFEGTSGIDAKNTMCEFTGDILRTPVSEDMLGRVFNGSGKPIDKGPPILAEDFLDIQGQPINPWSRIYPEEMIQTGISAIDVMNSIARGQKIPIFSAAGLPHNEIAAQICRQAGLVKVPGKSALDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHSDVSNQLYACYAIGKDVQAMKAVVGEEALTPDDLLYLEFLTKFEKNFITQGSYENRTVFESLDIGWQLLRIFPKEMLKRIPAATLAEFYPRDSRH

SEQ ID NO: 11741 - protein, 118 aa, Phyllotreta striolata
GIAPGVENLASQNGFDTHRFGIVHILVVDQRGASAFFKFSEVFLRVRYYVFGLFEQVAASEFEQHGSQFVRDSDSCPFAFAYFVHFRLFNNFYCSMYLEFDLSDCDKLHFSIIKRETC

SEQ ID NO: 11742 - protein, 806 aa, Phyllotreta striolata
MSYMQTNQNRPMSQGYHQGGNDLPMQSSKEQTLLWQQNSYLGDSGIQSGAATQVPSLSGKEEEEMDLFDLDQPYQGFTQEQVDEMNNQLNHTRSQRVRAAMFPETLDEGIEIPSTQFDPNHQTAVQRLAEPSQMLKHAVVNLINYQDDADLATRAIPELIKLLNDEDQVVVSQAAMMVHQLSKKEASRHAIMNSPQMVAALVRAISNSNDLETTKGAVGTLHKLSHHRQGLLAIFKSGGIPALVKLLSSPVESVLFYAITTLHNLLLHQDGSKMAVRLAGGLQKMVALLQRNHVKFLAILTDCLQILAYGNQESKLIILASQGPIELVRIMRSYDYEKLLWTTSRVLKVLSVCSSNKPAIVEAGGMQALAMHLGNPSTRLVQNCLWTLRNLSDAATKVDGLESLLQSLVQVLQSSDVNVVTCAAGILSNLTCNNQRNKVTVCQVGGVDALVRTIVSAGDREEITEPAVCALRHLTSRHVESEMAQNAVRLNYGIQVIVKLLNPPSRWPLVKAVIGLIRNLALCPANHAPLREHGAIHHLVQLLMRAFQDTQRQRGSVASGGSQPPGTYADGVRMEEIVEGTVGALHILARESHNRAIIRQQMVIPIFVQLLFNDIENIQRVAAGVLCELAADKEGAEMIENEGATAPLTELLHSRNEGVATYAAAVLFRMSEDKPQDYKKRLSMELTNSLFREENLWNPDLGMGPDLQDILSPDQAYDNMYAQGPPSVHSSHGGRPYQQQGYDQIPIDMQGLEIGSHGGGNGSTYSAIDAMDVTSGEPDLNFDTIDQLPTPPQDNNHAAAWYDTDL

SEQ ID NO: 11743 - protein, 266 aa, Phyllotreta striolata
MARNAEKAMTTLARWRAAQLGEIDKHKKRRPYLASECKSLYACEKWRMQIIREIAKKVAQIQNAGLGEFRIRDLNDEINKLLREKRHWEDQIKELGGPDYQRVGPRMLDHEGKEVPGNRGYKYFGAAKELPGVRELFEQEPPPPPRKSRAELMKDIDADYYGYMDDDDGILIPLEIKAEKIAVQNAITEWVNNKEKNLDSSKTIEESIYAVEDSDEEETVERFDGSQQRFVAHVPVPSQQDIEQALLRRRKQELMEKYGVQDEQDV

SEQ ID NO: 11744 - protein, 214 aa, Phyllotreta striolata
MAAKDMPTFKCVLVGDGGTGKTTFVKRHMTGEFEKKYVATLGVEVHPLVFTTNRGKICFNVWDTAGQEKFGGLRDGYYIQGQCAIIMFDVTSRVTYKNVPNWHRDIVRVCENIPIVLCGNKVDIKDRKVKAKSIVFHRKKNLQYYDISAKSNYNFEKPFLWLARKLIGDPNLDFVAESALLPPEVQMDPQWQQQLEKDLKEASETALPDDDEDL

SEQ ID NO: 11745 - protein, 159 aa, Phyllotreta striolata
MTSIETVGTIVLKILKLVINLICIILYRTGYQGYFLGVGGTWNLNEEKNPDSEIVASGIFVGYMIYTIVSLISLCFASGDHKTSFTDILMNIVGVFMWVAVGATALHYWLGYLSEYKYSSVDSERQVGLALGALCVINGAVYLVDSVLSVVFIIKSKMQ

SEQ ID NO: 11746 - protein, 834 aa, Phyllotreta striolata
MPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEEGEDAVDDPRKLKPGEIDPNPETKPARPDPKDMDEDELEMLSEARARLANTQGKKAKRKAREKQLEEARRLAALQKRRELRAAGIEVTSRRKKKRGVDYNSEIPFEKQPAIGFYDTSNEALDLMAPDFSKMRQQHLDGELRSEREERERKKDKQKLKQRKENDIPQAMLQNEEPAKKRSKLVLPEPQISDQEMHQVVKLGKASETAREIATESGVETTDTLLNDYMFTPQAAATPRTPAPQTDRILQEAQNMMALTHVDTPLKGGLNTPLHNSDFSGVLPQSQAITTPNTVLATPFRSTRSDGGATPGSTAGFMTPKSGALTPVGKNATPSIRDKLNINAEETLDVGSTPAEHRMYQMSMKDQLKLGLSSLPQPRNDYEIVVPENEAQDEPEEAQSQLVEDQADVDARKQEELRAKAAQELASRSQVIQRELPRPQDVNLTVLRPPNESYSLTDLQRAEELIKCEMVTMLQYDNLKNPLPAQSKRSNMSQAQQLAFLEQHPYDSFKTEDLDVAKSLLRSEMDVVKSGMNHGELPLDVYNQVWEECLGQVLYLPNQTRYTRAHLASKKDRLESAEKRLEQNRSHMAKEAKRAAKMEKKLKILTGGYQSRAQVLIKQLQDQYESIDQSTLELNTFKFLAEQEKNALPMRIQSLTEDVNRQMEREKVLQMKYADYQNQIKELQEEYLGQMQNVPNEESNKYDEVTSTTNEENGMDTSENETVTAEN

SEQ ID NO: 11747 - protein, 157 aa, Phyllotreta striolata; identical to SEQ ID NO: 11072

SEQ ID NO: 11748 - protein, 416 aa, Phyllotreta striolata
MYGLQRYSFGYTLKNAVRYYSREPAKRSSFLSRLYDNFKDEMNKNKEMKESLKKFREEAQKLEQSDALKAARQKFETVEKEASKGGEVFKESLGSIKDRVKGVIDEASKSDLAKKAGKFTEEVGKTTHKISETAQEISKTGAFQSISEATKAVKQEIDNTSMEGRVYVSPKKLRKRTETSAVVQQKYYEPNTDATGVELHKDSKFYESWQNFKNNNPYVHKVMDWKLKFDESENPIIRASRALTEKVGDIMGGLFQKTELSETLTEICKIDPDFDTKRFLKQCETDIIPNVLEAMTRGDLEVLKDWCHEGPFNLFAIPIKEAYKKGYKIESKILDVDHVDLMMGKVMDQGPVLIISFTSQQVMAVRDASGAVVEGDPDKVMRVNYVWVLCRDVVEPDPRAAWRLLDLSASSNEQLV

SEQ ID NO: 11749 - protein, 301 aa, Phyllotreta striolata
MNSSDSELSDSDAELQQALLDGKLKPGLNKIEEAPKQFVNNISGLNQKIEEFKLKLPWIERLDCTNAQAPLAPELAAEMLVHEEKRSNQLRNNKKLPQFQPSEDPVLNDFKRELIFHRQAQATILEAIPKIKELGISTKRPEDYFAEMAKSDEQMHKIRENLKQKQEQQKRIERVKQLRQQRKEGKSLQVQLKLQRSKEKKEMMDQVKKAKKNFDFLDDKNKPMGKRAAEKRKMKDKKFGFGGKKKGMKKNTKDSAGDISEYRNPGKPAKKQAGKKFVNKNKPKQRLGKTRRIKTKAKGKK

SEQ ID NO: 11750 - protein, 221 aa, Phyllotreta striolata
EFCMLLALSILNIKIKSYIKFNKMNELEKLEYLSLVSKICTELDNHLGMNDKDLAEFIIHLSEKNNTLESFKKVLSENGAEFSDSFVSNLLRIIQHMKPKKSSNKEEFDKVEKEGLAFKFPGLAIPNEKQKPLQLEEFDNENENDEIDVVADMMKQLEADAPSQKQTKERSRSPSIEKKPRVRSGSRSKERRRSRSRSKDRRRSRSRSKDRRRSRSRSKDR

SEQ ID NO: 11751 - protein, 622 aa, Phyllotreta striolata
MNPGAPNYPMASLYVGDLHSDITEAMLFEKFSSAGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDESGVSKGYGFVHFETEEAANKSIEKVNGMLLNGKKVYVGRFIPRKEREKELGEKAKLFTNVYVKNFGEDLSEEQLRTMFEKYGKITSYKIMSKDDGKSKGFGFVAFESPEAAESAVEALNGKEILEGKPLYVGRAQKKAERQQELKRRFEALKMERLNRYQGVNLYVKNLDDTIDDERLRKEFSPFGTITSAKVMMEEGRSKGFGFVCFSSPEEATKAVTEMNGRIVGTKPLYVALAQRKEDRKAHLTSQYMQRMANMRMHQMGQFIQPGGSSGYFVPTIQATAPRFYGPAQMPIRTSPRWPAQTPVRPGAQGSTATYTGMQNSYRAAARPPGQSTMRSNISVPRPITGQQPPSMHGRPLVGQGVAAAGNRANFKYTANMRNPPQAMLSGAQAQVQQAVHIQGQEPLTATMLAAAPPQEQKQMLGERLFPLIQRMYSDLAGKITGMLLEIDNTELLHMLEHQESLKNKVEEAVAVLQAHQAKQAAIKKD

SEQ ID NO: 11752 - protein, 926 aa, Phyllotreta striolata
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSGLVEDQGFLEQLKELLSDSNPMVVANAVAALSEINESSPTGQPLVELSTNTINKLLTALNECTEWGQVFILDSLSNYTPRDEREAQSICERITPRLAHANAAVVLSAVKVLIKMMEILAGDTEFCNTLSKKLAPPLVTLLSSEPEVQYVALRNINLIVQKKPDILKHEMKVFFVKYNDPIYVKLEKLDIMIRLASQVNIAQVLSELKEYATEVDVDFVRKAVRAIGRCAIKVEPSAERCVATLLDLIQTKVNYVVQEAIVVIKDIFRKYPNKYESIISTLCENLDTLDEPEARASMVWIIGEYAERIDNADELLDSFLEGFGDENAQVQLQLLTAVVKLFLKRPQHTQGLVQHVLSLATQDSDNPDLRDRGFIYWRLLSTDPAAAKEVVLADKPLISEETDLLEPTLLDELICHISSLASVYHKPPTAFVEGRSAGIRKTLPARQGSDEGVGAGAAAAETTVIPNQESLIGDLLSMDINAPAPSAAAAPAAPLASNVDLLGGGLDVLLGGGSDIGGGGAVSAAAPTTTGLLGDIFGIPSAPTMYTPPKVIWLPAEKGKGMEIYGTFSRRSGQMAMEMTITNKAMQAMSGFAIQFNKNSFGITPCAPMNVPALQPGQNLEYSLPLNTTGPVQRMDPLMTLQIAIKNNVDVFYYACQIPIQILFGEDGTLDKRVFLTTWRDIPGANEVQYTLNDIKGNTDTVSNKMTLNNIFTIAKRNVEGQDMLYQSLKLTNNIWVLLELKLQPGVPTATLSLKSRSVEVAPYVFQAYESILKS

SEQ ID NO: 11753 - protein, 165 aa, Phyllotreta striolata
MPPKFDPTEVKYVYLRCVGGEVGATSSLAPKIGPLGLSPKKVGDDIAKGTADWKGLKITVQLKIQNRQATISVVPSAASLIIKALKEPPRDRKKQKNIKHSGNITFDEVLAIAKQMRPRSMAKSLSGTVKEVLGTAQSVGCTIDGKAPHDVIDEVNEGTVEVPDE

SEQ ID NO: 11754 - protein, 364 aa, Phyllotreta striolata
MSEEGKRALILVGGYGTRLRPLTLSRPKPLVEFANKPILLHQIEALVDAGVTEVILAVSYRAKQMEEELTVEAAKLGITIVFSHETEPMGTAGPIALAREHLSKSTKPFFVLNSDIICDFPFRELAKFHEGHGKEGTIVVTKVEEPSKYGVVVYDQNNCIESFVEKPQEFISNKINAGLYILNPSVIDRIELRPTSIEKEVFPYMATDKQLYAFELQGFWMDVGQPKDFLTGMCLYLNHLRETNSQKLYKGPGVVGNVLVDPTAKIGSNCQIGPNVTIGPGVVIENGVCIKRSTILRGAVVCSNSWLESCIVGWKCHVGKWVRMEGSTVLGEDVIVKDETYINGGQVLPHKSIATSVPEPQIIM

SEQ ID NO: 11755 - protein, 288 aa, Phyllotreta striolata
MASDGEEVISDQEKVKIVSDFILHSPPGEFNEVFNDVRKLLNNDDLLKEGVTGAFAQYNKDQLTPVRIENADQMVLITEYNDLGNNRFFDPRSKQSFKYEHLRKEASDYQPYSLDTTAEPWRAALDNEFIQYTRNHYKDGVCSVFGRSQNGAITLTACIEDHQFQPKNFWNGRWRSQWSVSLTDDSTAEVRGVLKVQVHYYEEGNVQLVSTKEIKESILVSNEAQTAKEIIHVIENAENLYQTAISENYQTMSDTTFKALRRLLPVTRTKMDWNKIVSYSIGKELKTQ

SEQ ID NO: 11756 - protein, 1258 aa, Phyllotreta striolata
MHVKMNFLLVLIISAVAVGAQEDAAGAQEDAVAPDAAGQDNTEDVESIDVGAARGDVGDVDPKPVPVEENNGGAVTNNLNYDAPVEQRSRKLTNTDSEIIDTNSSKPNWTFQKKTKSGKYVTYYGANYDPMTSATAPPDTDQRGGGIPYLITETRLADIRKHFMYPFFDKGGNVDNEGDYQKEIQSSTPQVHKNMNFQLPFFGFRYNYTRVSINGYLEFSDPPPNYDYPLVFPVKDWPKRNDPAFIGIFFSKCKIGNLRDEDVDKRKPGVYFRMERDLRDRQDRMGVEIRERLKWDIREGVIGSETFNPKHAIIVTWKNVSFNGGFGPAVFQTNTFQMVLATDEVFTYAIFNYLNLEWTSHTEAGGDTRNGEGGVPAFVGFNAGNGTRSYQYMPYSQASVIRDLTATGWGNGKPGRHIFRIDENILLGSCNKDIDGANLPLQFAPESGNMLGGTVVNITGPCFNPNDRIRCKFDVFDEVVGYVVDRNRAICIQPPLYTEGWVRLQIAVNSEAFKWKGKYYVESPATASQKIFFKDMKYHEKSPSEFRITWQKQNLTTNENANIRISLWGYRETTMRPTFVYITEIASTQNAGEFLISPSQYRGKVNQFLSDIKFGFLQINLTESVKVNIYSTTNQNVEITPVIWSRPIPLAWYFQFQWESQYGKNWPKHLCDDWLRTDRYLKNFAHELPQCPCTVQQALADKGKFMPDFDCDKDSNPVCYYNNQALHCVKTGAPTMEGSEQQCCYDKNGYLMLSYDQQWGSSPRRCHNLGKMPYNEATKVPTLSQWFNDIVPKYLCCLWQEEQAVGCETLRFERRPSQDCVAYQAPGVAGVYGDPHIVTFDDVEYTFNGKGEYSLVKSVKVDDNLEIQARFEQMSPNAYGEVRATQLTAIVAKGNKTIPIEVRSRPIESRWRYRLDVIAENRRLYFDRPSLKFQHFQGVTVYTPTYILNQSEVLIMFDNGAGVEVLDNQGYMSARVYLPWSFINKTVGLFGNWSFNKEDDFTLPDGSKAAVVSNINDMERVYNDFGSKWMLDDVGDERKGQSLFYREFGRTSATYNNKTFRPQFLMLPEDILPPNRSEQIQRTYEVCSTKMYECYYDYAMTLNRDLAHYTQNYKATIYELKQTTREKITSCGVLETPRFGRKSTFLFVPGTKVTYECIQDFVLVGDPRRECGADGKWNIPEYGYTYCLRQQEYSQRQAGITSGIIMLVLIPLILLFVYLAYRFLKKKQKERDESRMQQDQYREQSRKAQEAATRKLTE

SEQ ID NO: 11757 - protein, 100 aa, Phyllotreta striolata
MSSSSDSDSTFFSSFLDSFFSSAAAGAAATAAAATGAAPPTGMELNFSRPLVMSSSMDLPLSSPKTFLTFSASASTPTEPRIFSTSAALGEAFPPKAANK

SEQ ID NO: 11758 - protein, 818 aa, Phyllotreta striolata
MTDRFGLKWDPKNLEIRTMSVEKTLEPLVLQVTTLVNTKGPSKKKKGKSKRANALVSTVEKATENFIEKGEQIAYENPDITDEMIAAVEEVRKTGNAMSIAAREFSEDPCSSLKRGNMVRAARNLLSAVTRLLILADMVDVHLLLQSLHVVEDDLEKLKNASSHGELLDNIKNFGHNANELMNQAAKRQQELKDPQLRDDLAAARAVLKKHSTMLLTASKVYVRHPELAAAKANRDYVLKQVCEAVNTINDVAQGRTPQPASGPYDGPGELAAALDDFDDHMVMEPLAYNEVHTRPSLEERLESIISGAALMADSSCTRDERRERIVAECNAVRQALQDLLSEYMTNMGKKDKSDNLNRAIDNMGRKTRDLRRQLRKAVVDHVSDSFLETNVPLLVLIKAAQNGNEKEVEEYAVVFTEHSNKLVEVANLVCSMSNNEDGVKMVRYAAAQIDNLCPEVINAARILAARSRSKVAQENMEAFKQSWENQVRILTEAVDDITTIDDFLAVSENHILEDVNKCVLALQEGDADTLDRTASGIKGRSNRVCNVVTAEMDNYEPCIYTKRVLEAVKVLNDQVMPKFTQRVQVAVQALGNSPPKEVDENDFIDASRLVYDGVREIRRAVLMNRADEDLDPEDVELDENYLIETRSKSSAHTGEHGVDEYPDISGITTAREAMGKMPEEDKQKILQQVEFFKSEKLKFDREVAKWDDTGNDIIVLAKHMCMIMMEMTDFTRGKGPLKTTMDVINAAKKISEAGTKLDKLTRQIADQCPESSTKKDLLAYLQRIALYCHQMNITSKVKADVQNISGELIVSGVRYTL

SEQ ID NO: 11759 - protein, 407 aa, Phyllotreta striolata
MSFNFGNTSTPKTAATGFTLPSNPATTSATGLQFNFGGGDTKTEVKPSSTLFSTATSGAPAFGIAPQPASSASAAPSFNFGTPTTQQPTASAFGTAALASLSTPTSSSQFGLTSRAPKDTSGLYGSTTAAAPTPASTGLGFGPAVSTTSSAAPATTGTTPLFGVASTPSTTTLASAPALGLSTTISSAASTTPSTSLSTTTAPPAYSTSTLTSTGSLTFSQLEDSINKWTIDLEEQGKFFINQAKQLNAWDSLLISNGEKILNLNGSIERVKQQQQQLDQELDFVLAQQKELEELITPLEKELLEIPVTDIDRNQMYQFSEIIDSQLKQMSDDLKEIIEHINESNKSEEVSNPLTQISRIMNAHMNSLQWLDRNTAQIVSHLEQINKMQDSNRRNFPLNHSFNNSLL

SEQ ID NO: 11760 - protein, 193 aa, Phyllotreta striolata
MFIWDWFTGVLGYLGLWKKSGKLLFLGLDNAGKTTLLHMLKDDRLAQHLPTLHPTSEELSIGNMRFTTFDLGGHSQARRVWKDYFPAVDAIVFLIDANDRSRFVESKQELDALLTDETLANCPVLILGNKIDLPDAASEDELRNVYSLYGQTTGKGKVARSDLPGRPFELFMCSILKRQGYGEGFRWLAQYID

SEQ ID NO: 11761 - protein, 187 aa, Phyllotreta striolata
MDPIAVLEKRIEALELQVFPLGDYKQISNKTQTITNLLVETQTMINSALTCRESITSMLQHLVVINDYLNPTSEADELEVEAKRQYLLELYPELKDTIQTVSTLESLLPFIDSINISKVVEFSGKLEEVAVGNLKLYGECRDITKKVLVALQQYNDISNSIKLLFSQLDMAVTNLEYALQLRDANEE

SEQ ID NO: 11762 - protein, 583 aa, Phyllotreta striolata
MNNAKFQEVYSDLTLYTTPDKFFIEPKAGEELMVIERNSENIICFKSDHRHLIPAANSRKDFCGLIGIIQLLACPYLVVAVQRELVGYIAGCAVWRLAKAELIPYRSCAHLSPEKQADNDVYLSMVYSVLSTPFLYFSYDYDLTHSLQRLHGISPDFWKQSLFERADQRFVWNGNLLYSFKGFSIHRFCLPLMHGFVSINFCVVNGHSLNWSIVSRRSIQRAGTRLHRRGLDKEGNVANFVETEQIVEYQGDRASFVQIRGSIPLFWQQDPDLRYKPPPTLLDVDPQDQHSMCLKHMNDLMTFYGKIVCVNLVDQKGAEGNMEVAFKNAITNVSSPSVKYESFDFHAECSKMRWDRLSILIDRLAHDQDEMSFFLLLRDGSLSSLQDGVFRTNCIDCLDRTNVVQSMLAHRNLESVLRKLQILHQNQTLEFQYSFEVLFKNVWADNADIISTQYSGTGALKTDFTRTGKRTRYGLLQDGMNSLTRYYKNNFADGLRQDGIDLFLGNGKPVSPLHIDKGWKYVTYPSILLIAVAMFVACAVTPSEYSTDSLLFLLFWGSMVYATLHTILKYGSEFVDKPRLTHS

SEQ ID NO: 11763 - protein, 501 aa, Phyllotreta striolata
MPPTIQQNNQNAANGVEKRQVKTVEKRSDLLCKVKYCNTLPDIPFDLKFITYPFESIRFIQYNPTSLERNYKYEVLTEHDLGVSIDLINKDIYAIGAGASLDPADEKLLEEDILTPQDSKRSRHHAKSVSWLRRTEYISTEQTRFQPQTMDKVEAKVGYSIKKSLNNETLYMDRDSQIKAIEKTFEDTKTIIDKHYSKPNVVPVDVLPVYPDFSLWKYPCAQVIFDSDPAPVGKQVPAQIEEMSQAMIRGVMDESGEQFVAYFLPTEETLQKRREDVANQVQYQDEEEYEYKMAREYNWNVKSKASKGYEENYFFVVRSSGIYYNELETRVRLSKRRQKVGQPPSNTRLIVKHRPMDANEFRMQRYREKQLEPTGEDDEEMEMDEPQDEENVLEPDNESRDKETESDNEKKRSRASSVSSQRRSRSRSHSSAKSNSRSSSRSLSKSRSRSRSKSSSRSRSRTPSKSPTRSRSASKSPSRSRSPSSARSKSASSSGSNSESE

SEQ ID NO: 11764 - protein, 389 aa, Phyllotreta striolata
MPIENLEDQGLEKNPDLELPHYKFLLTLPEYRSDRNVHSKITEAIKKDDMAPWYELLCKEVGWKLDAALLKTLKAKNAEKVKLLDEAIEDAEKNLGEMEVREAYLRKAEFYSRIGDKENAVSTFRQTYDKTVSLGHRLDIIFHLIRIGLFFMDHDLITRNIDKAKTLIEEGGDWDRRNRLKVYQGAYCMSVRDFKTAANLFLDTVSTFTSYELMDYKAFVRYAVYTSIISLPRNQLRDKVIKGSEILEVLHSEPFVKDYLFSLYNCQYAEFFSNLAEVETILRKDYFMNPHYRYYVREMKISAYTQLLESYRSLTLQYMAEAFGVTIEYIDKELSTFIAAGRLHCKIDRVGGIVETNRPDLKNAQFNSVVKQGDLLLNRVQKLSRVINI

SEQ ID NO: 11765 - protein, 1986 aa, Phyllotreta striolata
MEELTSGLDPDDLMDLDEPEGSDLDEDDDDLIDDHVSSPFISSSAPESTANSVASSPIHEDFPPPFNFTGKPLHVKRGRGRPRREGGKPSAPRTTRGGGTGVSRVRRPRPPGFSRRGSLGGSRSVRQVDRSDYEMSLFAGSPVDDGLLDPETGSMIFPEKFVPAIEEPPYFPEHWPGKVCALCNLGERSQLGQGEMLRLNCPEGFSPEKVISEQILERALQAPDKECGDKSPKGPVTCRRQKSFNKCRHPSITSEYVDELTIIGYNEVPDVSSLFEPNGQFYVHRNCALWSNGVTKAENSALLNVGPVVSQSSSKKCSFCNHYGASLTCDVDKCTKTYHFPCATAAGAFQDVSSLTTLCNDHYGQVAMLTDASPCLTCASMGDIANLMFCSGCGAHYHGICVGLAQLPGVRSGWQCRKCRCCQVCRVVGDESKLMTCEQCDKIYHASCQRPIVTSIPKYGWKCRCCRVCGDCGARTPGAGLSSRWHAHYTVCDSCYQQRNKGFSCPVCHKAYRAHAHREMVQCSSCKKFVHGTCDPEADVVTYSQKKEISVEYEYVCLHCKNSTARQITAKRASIDDPSDVSASHDSLYDDTSEFDLPSPDEFARNMGLGKGKPYSANKIAKKRLSFTVNPVGRPKGTGKVPPGKMGYMKRYRLTEFNRKRGPKAKMRGIFGVPGVGLQRPISDGKTDEEPGVENRLVLCSAKDKFTLTQDICVMCGAFGTDQEGCLISCVQCGQCYHPYCINVKVTKVILQKGWRCLDCTVCEGCGQRNDEGRLILCDDCDVSFHIYCMDPPLDYVPHGNWKCKWCAVCHSCGATDPGFNCTWMNSSTQCGPCASHVNCAGCNEPYAEGDLIIQCVQCDRWLHGACDSIKCEEDAEKCAEDGYNCVLCRPRDVPPPHLAPAAAAPKPPTPTKSPELGKSTSYYMDGVCLSEFGSNLIKSLALEYHGSRKKRKKIPTVQDKEAGIMATIESVVAGGNVIPTNMEDSAKLELVDIKDEPQELYKEGMMWTKEDGPPPEGFTIITMENGLNVLRRKRQRNLQKLGIGGFVVRMRGIRTGQDNDDVDSTVGQSGLNPNDIVPSPADGDKPRRKAIRRKPKSKLAETFPAYLQEAFFGKDLMDTVDCKKEEVDCYSSDDEKTDKHYKSINLSQDEIIAIVASGKTEKLENDNKDSTKEFGSNQPKNPFKPTVLKEEEEDNPEDLKDVLALPGDLLDTDLVNSIMEDEEELSKTTASLVALDSNLQHDAELTDTLSSSGNSKETKDELSDILGPHFNLDSISNINSKDVEDIFKGVLTDESQESQESSNFTLQGNSMFSNNNSQQNVAQHPIINQPVRPKTLPTVNHNLNSPVGFPPPSPYHSEYSNSPQFSPAFAESSCSWVSGSDAPEIDSTNVTVTSTYNQRSSDKMKADESLGKSATISAVLYANINHPEWKKEYPNWPDRYKQIIKKWRTLSQEQKAPFLQHARDNRSQLRMKKAQQSQTVKETATSTGTSPNASKPLHQAGPALATTLQAAAQQPAAVVPAAAAAAAPPAAAAAAAPLSEDQEKIALQQKSAREAEQERQWKQLQALRQQQTQQTQNILHEQRVQAIARVQRQISADPAQQFINEQQGAMQANAPQESSPSTTPAPGPRQFLGIKSPTFPVPPAGVRANAPSQSPHDVAQPPTPDGNDHFIHSPTNPKPNFPPRLPNDPFAAQPAAPRPPFGMARPPLQNFGGTVRNEQQDININRQLRELLQRQQVKKLDELLPGKAPPPPPQRLWHANDQQEGGGDASMTSGGAQGADATFRQPLPPGVVKPRLAIAAVNRPILNAVRVNQLDPRIQNLDPRMRLILQHQQQRLATGIQQQFIRFTSNVRPTTVEQYEQLLQRQGNNQNQMHAEDQQQGVARMPVAQSGVVQRPHVAQASVTGAVATASTESNPSEEGIPDNVTAELEKLEQETGTMVELQGVSDILGGLDDDDELLAEMGADFNILEYADPELEALTGGKTN

SEQ ID NO: 11766 - protein, 1483 aa, Phyllotreta striolata
MEDSPLEGRSSKRSKTFKAKASEKFKQFKRGVKNKYEVGEVENVYEVVEEKQYIKEVMSRCDDDWIVGDSSGYIEDGRDIFDDDLDVESIAQASTKGKGVKRKHKNVSENAGKGKLQQMFSTMPAKQKTAAKVDDDEMLSEILGEIGTGTANKPTVEKPKIDQYSTLAINISAKNYMKNLSQPVKKRAVEKKVQKIQPSVPKRFENLKEKLPEPVKIQAKENEKINPDKVIEKETMDLDKNTEEEKLDLDTSHFDDGLDETLLEEFNEDLNNTASESQITESEMIGDDFAGDFDTTQIDEIEEQINLASEQLINDIQAEVETEWQYFNNANESFKIATGSEDAESSSAIPVDTPFVKVDGKNVFRFFWWDAYVDPQHQQGTVFLFGKTYCETSKKYESCCVAVKNIERTLFVLPRPFELDENGKPTDKPVTFKTVHDEFNNRILKRTGITSFKSRLITKKYAFDANIPAESEYLEVRYPASFPRILCNEDRQHDDDESTDNDDLGYSTFSKIFGIKTNFLESLFLERKIKGPCWIDVSDPETAANPMSFCKFEVNCLKPNNLKITPFEKPVPPPPLVVATINMRNCINRASSNHEIVMLSCLVQNRYAVNKPPPEPAFQHHFCVFSCPGGQVLPLNLYDTLQNYKITKVLKTDNEKAMLNCFINNIVQIDPDLIVGHNLQGYQTAILADRLLKLNCRAFNRLGRLKKRATQAKQLERTLFLGRLVCDIKISAKELIKSRSYDLDTLCQVVLKLKENQRVDLEPEDVFKMFKTSQDLIKLISFTMQDSGYIMKMMYNLNIVPLALQITNIAGNVMSRTLMGGRSERNEFLLLHAFHEKGYILPDKVYRSNENESKGSSKKKPTYSGGLVLEPKVGFYDKLILLMDFNSLYPSIIQEYNICFTTLPVMDSDENLVLPDSNLPAGILPTEIRKLVESRRQVKSLMKKPDISKELKLQYDIRQMALKLTANSMYGCLGFGHSRFYARNLAALITQKGREILVNTKDLIEKMCLDVVYGDTDSLMINTNVLDYDQVFKVGVKIKQEVNKLYKQVELDIDGVFKYLLLLKKKKYAAVTLTKSLSGELVATKEYKGLDIVRRDWSQLSSETGKLVLEHLLSDQSSDEKIKNIYDHLATIKSDLIEGKIPIPLLVITKQLNKAPHMYTDKNSMPHVQVALRYNQKSRDHFRMGDTVPYVICTDNTGNGPMQRAYHLDELKGNPDLKIDYDYYLEQQIHPVIARICEPIEGLDAYQLAECLGANLKRVKRPKPQGGNENIQGENVVKAEVKFKNAEKFTFVCYICKHQNVISEPLMNNIPFLETCQNPECQSKPIDYLPSVQNQLYRSIRSHITKYYKKVLTCEDPSCPNAPRRLPLKFLKKRPVCNMCCNAVMYKVYTEFHLYNQLAYYRYMFDLSKLKHKPLMDGETESGYRTLQDTVDKFMNQSEYSLINLSEVFGQLGWSGASEKVTVEQPSNGVHFNEEGIEDAYDE

SEQ ID NO: 11767 - protein, 465 aa, Phyllotreta striolata
MAAAAAAKIAEVRETTRVERIGAHSHIRGLGLDDSLEARHVSQGMVGQVSARRAVGIVLQMVRDGRIAGRAVLLAGQPGTGKTAIATALAHALGQDTPFTSMAGSEIYSLEMSKTEALTQAIRKSIGVRIKEESEIIEGEVVDLSIERPATGVGTKVGKLILKTTDMETVYDLGGKMIDSILKEKVQSGDVITIDKATGKITRLGRSFARARDYDATGQQTRFVQCPEGELQKRKEVVHTVTLHEIDVINSRTHGFLALFSGDTGEIKPEVREQINGKVAEWREEGKAEIIPGVLFIDEVHMLDIECFSFLNRALENEMSPIVIMATNRGITKIRGTTYKSPHGIPLDLLDRTIIVPTQPYDEKELKEILNIRCEEEDCQMSDNALVVLTRICKETSLRYGMQLIMTSSLIARKRKAHEVDVEDIKRAYQLFFDEGRSVQFLKEYQQEFMFNEIDEKDDMEMETI

SEQ ID NO: 11768 - protein, 371 aa, Phyllotreta striolata
MTLRTYGDKPISFQLEENGEYYCVGSEVGNYLRLFRGSLYKKYPGMFRRSITNEERRRLIELGLSQHVLASSVSLLRAEEVEDIIEGNDEKYKAVSVHTSEPPMPREGKSKKNMQWVPSLPNSSHLDAVPQATSINRNRVAAKKVRTFPLCFDDTDPQINIENACQQELLVPIRLDMEIEGQKLRDTFTWNKNESLITPEQFAEVLCDDLDLNPLTFVPAIAQAIRQQLDAFPTEPPSIIEETCDQRVIIKLNIHVGNTSLVDQVEWDMSEKQNNPEEFALKLCAELGLGGEFVTAIAYSIRGQLSWHQRTYAFSEAPLPTVEVPFRNPSESDQWAPFLETLTDAEMEKKIRDQDRNTRRIRRLANTTPGW

SEQ ID NO: 11769 - protein, 192 aa, Phyllotreta striolata
MAAIRKKLVIVGDGACGKTCLLIVFSKDQFPEVYVPTVFENYVADIEVDGKQVELALWDTAGQEDYDRLRPLSYPDTDVILMCFSVDSPDSLENIPEKWTPEVKHFCPNVPIILVGNKKDLRNDPTTINELKKMKQEPVKPQDGRSMAEKINAFAYLECSAKSKEGVREVFENATRAALQVKKKKKHRCVMF

SEQ ID NO: 11770 - protein, 1337 aa, Phyllotreta striolata
MNTSTFNPRMDAAQNPAQKMELASRNVENSLLIDNNAPRLIDFMNINPQSGSTASGFADHDYPTLSGLSHIINSMTQIKCVSNVPIPSEIVDHFARVQCHCMMGLFSEINRAWLTVDSDIYVWTYEENTDLAYFDGISETIVCVGLVKPKAGVFHAFIKYLLILATSVDIVVLGVTFTERPGDNADEIQLIPDPVFILPTDGSTVTIINSTDDGRIFYGTKEGNLFEIAYQAESGWFGKRCKKINLSTSTLSFLVPSFINAALSEEDGITQISIDDSRHILYILTEKGSIEVCDLGEKGNSFSRISKMSQSTLVNQAMNTVKTLDSKNFRPIVSISAIETSESVNLNLVAVSQTGVRFYMTVTSLSNQNPNQRPYTLTLAHVRLPPGYSANITVRPRAVHVSQYRDRNLVLISTVNEKDVLWCMSSDLFPFGQGLTEAYTAINLDGPALAISEARSASPLQIKDVHEAPPLVVRQHAEPPKKYIVLTSHSIQIFIKLRPVDVLKQILKDSHGQDTEALKAFFTIQKEDQACATALILASLENEDNMEIAEFATRAFFLFGGEPKLAAPMNTFSGPSVFCPPVMSTPNIHQYQQQQQYQTSPQYQPNFPHGISPAANAYELTSPFVFSPKHNGLYLYLSRILRPIWHRRTVDKLCLDGKIVTNHSTVTSEDCIFILNYVTSLHNFLMRNTQLSSLSAAPGHNTQNFNNTTMNVTRLNHTIQDVQLEERASLDALKTFVCHCCQILGLWRILCEHQFHTLIASLPETEQQILQNTTFKDLLLYRHDICTLLIATLVDSYLGDNASVDSISSKLREVCPLFYKTEDAAFSKAVEILKMTRAIQNNDEKEEMIQSALQICKSIGPTINITDICKEFANLKAYKAVTELCAHFGKKIDPDKIAESYYNAEDNSGDQEGYNYYQRRLEIYRHILNMLDQLYNEQNQTQVISRDSAYSVNQTILLDGVEQSQVGYVMKQVIKDVMETPDEIMHFALYDWLVFKNMTGDLINIQNPSLETYLKRTSTQNPNNIETMNLLWKYYESCNNHAAAAKILNNLASRTGTNVPLKERLSYLARAIMCMRSDKIGYAPYLGVFLRDLEDKMEVAKVQEQILDAIVNLQGQIPNAQEAISALNSGLFEISQLYENFAEPFKLLECQLAIIECAGYTDQVLIESIWQQILTEELRKTYGTGTDKVCQLLNKVKQLSKQYAQSANCFPLSYIVYELEIVNAKLRGDKQLVPCALESMNIPFENLINVYNSLNTISINDHFWQLEENEFHLSEATAALINCFLGHLEQYSSVEKRKITSLCQDAVVALLSNLYSKPNTEVLVNKLRNIQAKLSRI

SEQ ID NO: 11771 - protein, 1380 aa, Phyllotreta striolata
MSEFTLGYREVTPEQIDYENWKEITLTTGGTQSTLQDIKVAERANGYCYKDSTKHCTRNRFIYWRINHNVLELVEHSLDINLTGNRIRYKFDTPILDGVSIHEILDNVVILVPTVCSVHRLIFPHPNIFHAQDDLLGIYPDLTAVSIFSKASIVDTRNPNSFYVFNNPSTANDQLPNLANSYFVPETGEAYFVLAFPSTELLLIRQSPDQVTCVELKGESLVPRFFAGIADKFRQRNSDSENIVSLLFYDLDEETYVLSLTQDAHLKCWSCSKGQCVAVIDVREKISTNLKYRVQSAILKKAEDGNSSDNILVLFLSFGNKCQFHILKPSIREQEISLHRLAALESPLNDLIDFAAQLDCLWSVWRSDVGETLVYKASFKSNQWTQVILEPEPCEKQFPIKFNDVKTMYLQHIFHPGRFPLHVINKTLSIYKMPTIASDSHLSISALKQRVCMAVENDIQNLFNRDGTDINSVEVDEYIECAEWCWQKFDSRCVQYQIASRKPLGLMLLPSVSGAMLLKKSAFSFLRPVDSLEHMTLCTDLYREQFFNFSMLADDLDAVDDVINVFKVIVYIEQQLKDDFMQSFETELLNLQSPDVVIEDLLKKIYVEMDSDFFSHILHLIKDVNDLYKAIHKILELLRYENTLANPDNDINPAAMYYFNSLLGTSLVAQSFRQQAEIRFQICRNLLLLCNFLVMDRTLNWGVLEGVRSVCMPDIVVLTQASFVVLWLSGLTMFESDSIRDSSMSTLNPLKLTPVYNLLPFTRCTSLLEVFISSSGVQDARKSFARVSCKDEALVRWHWSLLPYVNHIRHLIWPISGCTVFEEWLLSSGQHVWLQQYVRLLSNWCEWNACTRNFLLASSFLTTGEFYKAEELFETAAKGVFTDAFLKNRIKSVDESNSRTTIHYYLKVIQLFELCNARSHVINVANTALCVVKRDDPLAATLFSIKFKHHLALKHYRLAFDSLNSNPDGERRKDNLRDLVKTLLDEKKLNVLLNFTYDSMDEFFANIVLTRARAADVTDNAFYDFLYSYQIKKGPPSFRLAASAMYEQAFRLSQKTTVEALEKQVKCYLAAKNVLHLCPSQHAWVVRPADPDEEDEQVIFQPLAGSNGEIRTFKIKKQIEVVDIETIGKELTFASAKLKLLQFNPAVSISVCDPLELVISLNNSGMFKAAFEICSTFDLPYSLVFEALTKRCVMLTEAEDPNAWNWLVENDLQDLPVNRESAADVVWKFLQDCLEKYEEPRMSCLHNVVCKKIINMQIYLPHWLKASYKARNPSELLRLLHASGRLEEAVELAKDYILSAMGYGKEEFGFSQPLAPTSPAFCLPVYAIQRLVDELDVQNSMNVEKPYTHEYDDLKVLFSKYLETAIRVSNQMCQVKGRAF

SEQ ID NO: 11772 - protein, 782 aa, Phyllotreta striolata
DLLVATINLSQTHANDVAALKIIYSSLVLICKVFYSLNFQDLPEFFEDNIQVWMTNFHTLLSVDVKSLQSQEDSEAGVLEQLKSQVCDNVALYAQKYDEEFQPYLPQFVTDVWSLLVATNLQPKYDLLVSNALQFLSSVAERSQYRNLFEDDNVLSSICEKVIIPNMEFRTSDEELFEDNPEEYTRRDIEGSDIDTRRRAACDLVNTLSQNFEQRIVEIFGRYLQVMLAKYSENPKEFWRSKDAALYLVTSLVSRGSTQKHGVTQTSQLVDITQFCQQHVLPELERPDVNDLPVLKADAIKYVMTFRSVLPSDLVVSTLPQLIRHMPSESCVVHTYAACTLEKILMLKSNNQTIVTGAQLEPLASELLTNLFAVLQKPVSEENEYIMKALMRTFATLQDRIIPYLNVALPKMTEKLQMVAKNPSKPLFNHYLFECFSLAIKIICKVNPTAVTSFEDILFPIFQGILQQDIQEFIPYVFQILSLLMEHTPQGALSDPYMQLLPCLLAPILWERPANISPLVRLLAAFATQAAPQIVLQDKVGGFLGVFQKLLASKSNDHEGFRLMQSLIQNLPTEALTPYHKQIFFLLFQRLSSSKTTKYVINLIVFFCLYMVKYSPNDLVALIDEIQAQMFGMVLEKLLIAELQKIAGDVERKIVACGVTKLLCECPGMYTGSYQKYWPQLLQALLAFFEMPRDETTFPDDHFIEVDDTPAYQATSAKLNFADGTKNDPLQGVSEPRQFLVQSLATLGASQPGRLPTYINNMNAQSQTILQGYLAKFGVQLV

SEQ ID NO: 11773 - protein, 199 aa, Phyllotreta striolata
MAKVQLCNITVMDNPSPFLNPFQFEITFECIEELKEDLEWKMIYVGSAETEEHDQILDSVFVGPIPEGKHMFVFQADPPNVSRIPENDAIGVTVVLLTCSYKSQEFIRVGYFINNEYSDPEMRENLPSPPQFDKVIRNILASEPRVTRFKINWEESSGTQENGTTIAEAPANQTSETAASVEVPAFNENSNSWATMECS

SEQ ID NO: 11774 - protein, 312 aa, Phyllotreta striolata; identical to SEQ ID NO: 11659

SEQ ID NO: 11775 - protein, 200 aa, Phyllotreta striolata
VPCLACYSPGSVLSFLSVLGLLKIFEESFIFYPTKSPFKAQKMAAMRSMSRLLFSRSFQTTVKRGYADQMSFTFASGNQVFYDAKSIKQVDVPSFSGSFGILPAHVPTLAVLKPGVVTVYEDGGSVQKIFVSSGTVTVNDDSSVQILAEEAHPVENLDISAARDLLTKAQSQLSSATTDQARAEAAIAIEVGEALVKAAE

SEQ ID NO: 11776 - protein, 322 aa, Phyllotreta striolata
MSGDGNQNEHFDTLFLSIAQHHPQGPTQLLDTFVNFLSRKTDFFTGGKEGEWEKLVLNTFKKYEKSSREQHAAELKEKLEQEARRKAKKEAERARITELTDEQAEKLQAELDAKKAPSSAPDAPSSTSGAPSTSTAKIEEDEDESEKGKLLPNKGNGCDLDKYSWTQTLSDIELRVPLECDFRAKQKDLTVNITKKRLVCGLKNHRPIIDDDFQHEIKLEETNWVIEDGKSLLFSIEKVNKMNWWSKLVKSDPEISTKKINPEPSKLSDLDGETRGMVEKMMYDQRQKEMGLPTSDERKKQDVLKKFMEQHPEMDFSKCKFN

SEQ ID NO: 11777 - protein, 158 aa, Phyllotreta striolata
MQSPSGMAHGYPGASILQWSPDKKYSDRERWICVYPAYINCKKTIAQGRKLNKEKCVENPTHQEIRDVLVAAGLKVGVENKLYSRERSKELLYRGRIRVQLKNDDGTLCNPSFPTRDSLMLHLGDMIPKLKSRQNKGSGDPQPQTTSSKGKGKGKGRR

SEQ ID NO: 11778 - protein, 731 aa, Phyllotreta striolata
MEEPEPTKRQKMPKVAKVKNKAPAEIQITAEQLLREAKERDLEILPPPPKQKISDPAELADYQLRRRKQFEDNIRKNRTVISNWIKYAQWEESQKEIQRCRSIWERALDVDHRNITIWLKYTEMEMRNRQVNHARNLWDRATVLLPRVNQFWYKYTYMEEMLENVAGARAVFERWMDWQPDEQAWQTYINFELRYKEIDRARQIYERFVITHPEVKHWIKYARFEENHGFIHSARQIYERAVQFYGDDHLDEKLYIAFARFEENQKEHDRARVIYKYALDHIPKDETKELYKAYTIHEKKYGDRSGIEEVIMSKRKLQYEQEILQNPTNYDAWFDYLRLVEGEADLEITRETYERAIANIPPSKNKQYWRRYIYLWINYALFEELEAKDYERTRQVYKACLEILPHKTFTFSKIWLLYAQFEVRQKCLKAARKILGMSIGMCPRDKLFRGYIELEIQLREFDRCRKLYEKFLEFGPENCVTWMKFAELETLLGDTDRARGIYELAINQPRLDMPELLWKAYIDFEISQEEPNNARQIYERLLERTSHVKVWLSYAKFELNNPSEEDFNVRLARRIFERANENLKNVPEKEARVLLLENWKEFENNHGDDEHKEKVNAKMPKRIKKRQKVIDEDGVEQGWEEVFDYIFPEDEASRPNLKLLAAAKNWKKNTDEPDEDSENRPSLSSSSQRMKEKLLASVKNWKNNDKENSDSNKDDGSNEEEVQIDNNEVEN

SEQ ID NO: 11779 - protein, 476 aa, Phyllotreta striolata; identical to SEQ ID NO: 11438

SEQ ID NO: 11780 - protein, 161 aa, Phyllotreta striolata
MSTVSSSAVELSSYRDQHFKGSRAEQDKLLRLSTTLYVGNLSFYTTEEQIYELFSKCGDIRRIVMGLDKYKKTPCGFCFIEYYNREDAENCLRYINGTRLDDRIVRTDWDAGFIEGRQYGRGKTGGQVRDEYRTDYDSGRGGYGKIVQQKVGGIDSQGFIR

SEQ ID NO: 11781 - protein, 318 aa, Phyllotreta striolata
SNMVLILSRSFGVKLFKYKTNFTQTRLNSTGKLWFGSKKVFYRTLGLLATGTGIVIYTLDQAVKAGEMELHPPRFPWAYKGIITALDHASLRRGYEVYRQVCASCHSLKHVTFRELVGVTHTEAEAKAEAEQQMVEDGPNEEGNMFQRPGKLSDKFPPPYPNEEAARFANGGSYPLDLTYIILAREGGDNYIFSLLTGYCEPPAGVTLKEGLYYNPYFLGGSIAMAPPLFSESATYSDGTQAHASQLAKDVVTFLKWAGEPEFDDRKVMMVKCLGWFIVGSVISWYWYKMRFMSNKTRKFVYTGKSSTKKPECSDKCE

SEQ ID NO: 11782 - protein, 565 aa, Phyllotreta striolata
MLALQQYSGSSDEEEDKQTSSVNQEPSNPSEYSLKTQLAICAAPEVLPTGLEEDQMHIDVDTKELAFNPKYDVLFAPALGPANPFKTQQQLVERNMLSGHIERAHVSEFQFENQRRTFASYGYALDPSVTNDGQIKVVGSSEDADESSIKTVFEASKTRPLDKRKRKKNDDPSDVEGFLGPWGGFVDEQKISKPTEEEQIELDEISSKKNKKGKPSEDKPLEEKSVLHIKDAVDYQGRSFLHAPQDVGVNLKSDTPPDKCFLPKAHIHTWTGHSKGIAAIRLFPRTAHLLLSAGMDCRIKIWEVYNERRCVRTYYGHRQAVRDINFNNSGKHFLSAGYDRYIKLWDTETGQVLSRFTSRKIPYCVKFNPDRNKQHLFVAGTSDKKIICWDTRSGDIVQEYDRHLGAVNSITFVDENRRFVTTSDDKSLRVWEWDIPVDMKYIADPTMHSMPSVTPAPNGKWLACQSMDNKVVIFSSMNRFKINRKKTFSGHMVAGYACSLDFSPDMSYLTSGDADGKVYIWDWKSTKLFKKWKAHDNVCISVLWHPHEPSKLISAGWDGLIKYWD

SEQ ID NO: 11783 - protein, 268 aa, Phyllotreta striolata
MVQKKPKKKVGKKVAAAPLAVKKVEQKKEVNPLFEKRPRNFGIGQDIQIPRDLSRFVKWPKYIRIQRQKAVLQKRLKVPPPINQFSQTIDKQTATQLFKVLEKYRPETALQKRNRLKAKAEAKVAKKEETPSKRPNTLRAGTNTVTKLVEQKKAQLVVIAHDVDPIELVLFLPALCRKMGVPYCIVKGKARLGLLVRRKTCAAVALTQVDSGDRSNFNKLLEVIKTNFNDRADEIRRHWGGGILGSKSAARIAKLERAKARELAQKQG

SEQ ID NO: 11784 - protein, 333 aa, Phyllotreta striolata
MATIIKDITLQENIPQNILFEKHIDFIKEYGQKENNFEYAMTDYLRISGMYWGLTALELMNASPPHTIEEISDYIKHCQDPESGGISSCLNHDPHILHTLSAVQILCMYDNLKAIDVEGVVKYVKNLQLPNGSFTGDKWGEVDTRFSFCAVATLSLLNRMDAIDVNKAVDFVASCKNFDGGFGSRPLSESHAGLIYCCLGFLSVTNRLDIVDRDKLAWWLCERQLPSGGLNGRPEKLPDVCYSWWVLSSLTILGKLHCIDANALKKFILACQDTESGGFADRPGDIPDPFHTVFGISALSLLGNDTVQKVNPTYCMPQHVIDRLQLKPQILDN

SEQ ID NO: 11785 - protein, 887 aa, Phyllotreta striolata
MHQETLQLIQILEKTVSPDKNELEQASSFLEQASQTNLLGFIKTLSDILRHGGNSPVARMAAGLQLKNQLTSKDTTIKATYQQRWLLFSEEVRDYIKKNVVGALGTETNRPSSAAQCVAYIAVTELPQGQWPDLISTLVSNICQGNSTEMQKEATLEAIGYICQEIESDVLVSQSNDILTAIVHGMRSSEPSNHVRLAATQALLNSLEFTKANFDLTTERNYIMEVVCEATQSPVSQIKVAALQCLVKIMSLYYQHMEPYMAPALFPITLEAMKSENDAVALQGIEFWSNVSDEEVDLAIEDTEAAEAGRPPTRVSRHYAKGALQYIIPIILQKLTKQEELDDEDDWNPSKAAGVCLMLLATCCEDEIVPHVLPFIKENIKSDNWRFRDASLMAFGSILGGLEPNTLRPLVEQAMPTLIELMYDNSVIVRDTAAWTFGRICEIIPEAAINENYLKPLLESLITDLKAEPRVAANVCWAFSGLAEAAYEHAAVNEETGTPDTYILSPYYEFIIQRLLETTDRADGAQANLRPAAYEALMEMVKNSPKDCYVTVQKTTMVILERLQQVLQMETHITSHNDRSQFNDLQSLLCATLQSVLRKVTPEDAPHISDAIMTAMLTMFNSNSCKSGGVQEDALMAVSTLVEVLGENFIKYMDAFKPFLYIGLKNHQEYQVCGTAVGLTGDIFRALKLKALPYCDEIMTLLLENLRDQSVHRSVKPQILSVFGDIGLSIGSEFKKYLDVVLSTLAQASQAQVDRSDFDMMEYLNELREGVLDAYTGIIQGLKGDGLTPNPDVMVLEPHIPFIVQFITVVAQDDEHSDGTVAVAAGIVGDLCTAFGSPMVQLLDLASINEMLAQGRRSRVGRTKTLATWASKELRKLKMPAPAAAAS

SEQ ID NO: 11786 - protein, 499 aa, Phyllotreta striolata
METILEQQRRYHEEKERLIDGMVKEMLHKKNTYREAINSDHRQKYLLDRYMTSTERLIELYEDKDGQRKAEVAALTGPNEFNEFYSRLKQIKDFYRRHPNEISVPMSVEFDEFAKARENPNEDMANFVEFTDEEGYGKYLDLHECYEKYINLKGIEKVDYITYLAMFDQLYDIPKERKTGEYRKYLLYLIEYLTWFVQRIRPLMDLDSDLQDQVEQVLANWDNGMVPGWPKETGSALANVGAHLDLSAFSSWEELASLGLDRLKSALMALGLKCGGTLEERAQRLFSTKGKGSLDPSLMTKNSKNRVTKEKEALRQRELATLEAQIYRLADLVSAQRAATKENVQRKQARTDGERDDSENEESEEESPDEADDDVPYNPKNLPLGWDGKPIPYWLYKLHGLNISYNCEICGNYVYKGPKAFQRHFAEWRHAHGMRCLGIPNTAHFANVTQIEDALALWEKLKVQKQSERWQPETEEEYEDSPRSLANLRIPLQSPAATS

SEQ ID NO: 11787 - protein, 212 aa, Phyllotreta striolata; identical to SEQ ID NO: 11446

SEQ ID NO: 11788 - protein, 399 aa, Phyllotreta striolata
MQTFRKMDVNSLIILYWYRRRFRRNKTRRYWVHPLVKQRSHVGAFRLLMSQLRQDESKFFNYFRMSISTFHDLLQRLQDKLRKQDTNMRKAVSPEEKLAICIRYLASGCSFRDIHYSYRIGISTISNIIEEVTECIWNNLHHEFMPIIDKVSEWEKISDAFDEKANFPHCLGAVDGKHIRLKKPSNSGSMYMNYKDFFSIVLLAVVDADYRFIYVSVGSYGKECDSSIFKESNFWKKLTEGSLNIPQPRPLTTDSTTAVPYVIIGDEGFGLHDNLLRPFGGTHLDKEKRIFNYRLTRARRYVECAFGIFANKWRIFHRPLDVKKETAVSIVKACTVNHNFIREKEGLNIERNQEEEYNLENVNNEQQTRGGRTANSVRSEFVKYFISEEGSVPWQEDSI

SEQ ID NO: 11789 - protein, 2420 aa, Phyllotreta striolata
QQQQQIAQMNAARLQQQQQQQQQQQQNNPPHSPMPPKSPMINQQIMSPHSMPQSPMQMPPKSPMVPFNSNQPNPNSPAARSPAFHQGINQPPSPVTHGHQPPSSPMPRSPMINQTHSPHNVRRPPSANSSPAMPDRPHSVENSSPRMYSIDQLVQESLANQNVNAQYNYQSDMINESGGGNSNNPIPCPPEVPRFRYFKLGLRGGAPMWSFGRGAKRIPAPPNVKPDEPKAKKESHLSKVSILKRKTSIASIGKVGSLVSSDYNDLDDSSTTPPVTPPLASTSRGIVSKKKNLELHAQKDSVIVMHSPDDDNKQLELMDYDDDNNTVLSSEVSLSSAARNDDDLVEIETISQDLAEGLSSPLEPDQIGDEFLLFPGNMVVDMSGEEHYSEKEEEGEYADQNMHIVIRSPTTSDDEFIVPCKVKQYDEDEPDENPESPDQEEFGESSGYDNEEADIIISDQTSGVAEDSISTKEDFEELIDEGSRKNNVGKQEVTAKHIQDFHRYTELFDYGKPDVKKPAAKKFQPKVSLVRGVTLPSKPNAEKIIITQNSNTSQASKVTSIILTHNANVRRNIIGVPKIVSTVSPAITIVSASTSQMASILPSKFTVPVISASAVRQLSNVKVIDKPSSSSLSISTRDNVLPKKIFEDDSVSPDSSSNCDDEKSKDSFDDKAKCESPPRDLKQPNSQIVSLKSKTYAEQSKKIEHLQIVNVSSKDVVQRQRMPSPLIAKASPVIIHNTPELKMTAQVIQESQTRMNITTTTDTEHYDESNDDTKSVVISIPSPTPSQEQMLDNIAFQALENRRREYDSIEDVLDMIENIENITAEPPEILEENTLQSSESGSNIETKNADTKESQLPVSESDSSATKSSTVPQLSPLSQPTELTTNMANASQQLRTLLSSLQTTSTSSPTNVESVAKGLGQKIVTSSSANQPIVASRVMGQQQQAGRQSPVIAGVSTVIVPNFKQKIAATATSTSRSSPVKVVTTSQQLAGSIITSALNYLPNRTIGIQLAPEQSKLAPASVAAMQQINSITSSQEAKKPSLTLTAMLQNQPAANTISKSSADTITAASLLGSPISLPKTGFTTSLVQAQPSVVLSSTPPAPGQASSSTKTTADSITAASLLSSIAKSTFASTSSANKTPTSTTNLLHTQLTKVARSKSVDDVKDLAKIDEIKQSISSENVDDGSNGGCKLSTIATSVCNKTEDSQNVLLKKLLQNTACASAQSSPPASTSTVTTSAASAIAKAANSQASISASVDPPPVVSAPPNVAIQRSASRDELLSPPQDLQSMVVIKKEPPLVPLSQPSPLTNSNSNAATPEVKKEFIDESSQHSEVSDHSRSDAPIKEELETMETAAEKTMLDKEELKKQKRRMYQQKRRQNQILNKELAQQQQPKKRARKNSKLDEDYDTYIDGVLAQLRQLPPIAVSEPVLGRNFGAVPLFGCGDLAKIGAKDYSTHLGELTGSYGYAEAPGFTDFYSTKPYGDLDPLPEKPPASTQRGFYDQEFPLIRFDVDEQRKFDVFCREDSPDSILSSSSPECTRRSESKFVGLRLISDSEDDEEDDAKDAVSNGRMSPVVPVIKPVPIRLKPAGELYFKENLNENKENINSDSLHVMTKSKFDNKQSPPANVSGHVTVTLTLTSSAAEDIMGVLRDLANILHIPAPTSYQIVERTASPPSQKLGVYRTKGKDGKEGAPIDIQSILNGATKFCKHCDVIILSNMIRRKASDLPFLAKDSDLLGDGEELFFCGSACYMQFALMHRSPSISEDKAAEIINHLSQKDNLDANQKLPAADSLDNTKSIAQKLSFNVKDSKREFEPMETNDAFAFFARTASAKQGNNFYDGAPFKQAPARVHRNDRYKLWTPGCLQPTQKHKTPTDKEIMELLYRMQITVTPPVMPEDTRKCLFCHGIGDGVADGPARLLNFDVDKWVHLNCGLWSDGVYETVNGALMNVENALQTGLSATCVHCQSVGATIKCFKTRCSSIYHLNCAVKDNCVFYKNKTVFCKAHAPKSEKDNELTTLSVSRRVYIERDENKQVAAVMHHSDSADLLRVGSLIFLNVGQLLPHQLQNFHTPNHIYPIGYKIIRFYWSMRNLNKRCKYICAIRDASGKPEFRVTIQEPPEADVEYADATPKGAWQKILDNVAGIRKANNCLHMFPKFATGEDLFGLTEPAIVRVLESMPGIETLSDYKFKYGRNPLLELPLAINPSGAARTEPRLRSQLHWKKAAHTQRTTGGASSIRPMFGPSLAGSIGAPAQGELACPYSKQFVHSKSSQYKKMKQEWRNNVYLARSKIQGLGLYAARDLEKHTMVIEYIGEIIRSELAECREKQYEARNRGIYMFRLDEERVVDATLCGGLARYINHSCNPNCVAETVEVDRDVRIIIFSKRRILRGEELAYDYKFDIEDDQNKISCMCGAPNCRKWMN

SEQ ID NO: 11790 - protein, 699 aa, Phyllotreta atra
MPTERKRKSFITTMPREDVLERYKHKSHKRKKSRSTSRSERNQDERKHSSSSSSKKKSSFREDADRKKKKKRSKSSSSDSESTSSESSGNSVKLLKKLETERLRLAEQKMKEKELLKATETAEEKRLRRLMKKEAKERRRKEKMGWDNEYLHYTNSDNPFGDGNLLTTFVWNKKLSKEGIKNVGHEEIEAINRLKQEENKRELEKVKKRRLERELERQKREEETQMMQRTKEAAQFEEWERQEDKFHLEQARLRSHIRIQDGRAKPIDLLAKYISAEEEVDAVEMHEPYTYLNGLQIKDLEDLVEDIKVYKELERGKNLDYWNDITVIVEDELQKLRKIEKQNDFDLGLNRREGIHQSVATDVTSVFKGKTAAQLAALEKQIGSKISSKADGIDIGYWESLLSQLKAHMARARLRDRHQDSLRRKLQVLKAEQAITGVGQSHSETHSTDNEETTSEPKPSTSQDALETMEESNERTEDAAHAWLNECFSAYQAGGYSPKFLTPDDTEPGTIVVSEEDDVNRLEFARMHVLGQGTKIENVITKEELLLQKEARKGMDGDEAQFSVEQALDNPVYLWSDKYRPRKPRYFNRVHTGFEWNKYNQTHYDMDNPPPKIVQGYKFNIFYPDLIDKSSTPEYYLTPSPENKEFAILRFHAGPPYEDIAFKIVNREWEYSYKRGFRCQFHNNIFQLWFHFKRYRYRR

SEQ ID NO: 11791 - protein, 432 aa, Phyllotreta atra
MDNLEANIMDKSMRSVFVGNIPYEATEEKLKDIFGEVGQVLSFKLVFDRETGKPKGYGFCEYRDQETALSAMRNLNGYEIGGRNLRVDNACTEKSRMEMQNLLNQPPIENPYGEPIQAEKAPEAISKAVASLPPEQMFELMKQMKTTIQNNPTEARQMLLQNPQLAYALLQAQVVMKIIDPHTAASLLHPVNQVPATLLPGDKNVAVQVPINNQYREPPAPVQPPRQEYQPVPPPLVHPNHVQQPVFTGQDVDLRSMGNVTDPRIRPMIVDQDMRQMPAVIQNPLPPTISESLAKAGDSKPDNFSRDPRSGTGFPSDPRQARMDPRQKNIVPPTSQQVPPTVNPKIMPPQAGPVVRPAQNVIAQSAAAASVSAATANVSPGIGGAGATDQEKAALIMQVLQLSDEQIAMLPPEQRNSILVLKEQIAKSAHVR

SEQ ID NO: 11792 - protein, 260 aa, Phyllotreta atra
MDAEREKSLQEYRKKLLEHKEVESRLKEMREQLKDLTKQYDKSENDLKALQSMGQIVGEVLKQLTEEKFIVKATNGPRYVVGCRRQLDKAKLKAGTRVALDMTTLTIMRYLPREVDPLVYNMSHEDPGDVTYSAIGGLSEQIRELREVIELPLMNPELFMRVGITPPKGCLLYGPPGTGKTLLARAVASQLDANFLKVVSSAIVDKYIGESARLIREMFNYAKTTNRASSSWMKSTLLVAEGSPKVHRPIEKSKGRLWSC

SEQ ID NO: 11793 - protein, 259 aa, Phyllotreta atra
MARRYDTRTTIFSPEGRLYQVEYAMEAISHAGTCLGILANDGILLAAERRNTNKLLDEVFVSEKIYKLNDDMVCSVAGITSDANVLTNELRLIGQRYLYQYGESIPCEQLVSWLCDVKQAYTQYGGKRPFGVSILYMGWDKHYGYQLYQSDPSGNYSGWKATCIGNNSSAAISSLKQEYKEGDMALKDAKGLAVKVLAKTLDMAKLTSEKVEMATLTRRNDKTMINILNSKEVEELISEYEKSEAAAEATKKQEQKSAA

SEQ ID NO: 11794 - protein, 888 aa, Phyllotreta atra
MSESTKAEPIKVESKTTDDKNKNELSDEDKQLQEELNLCVEKLQENDSKLYMPALQALGNHIRASTTSMTSVPKPLKFMKPHYDTMKQIFEKITEPSVKSLCADIISVLAMTMGEGRDCLKYRLVSDLDKIGEWGHEYVRHLAGEIAGEWAETDFLVNTEIRDKLILLTKQIVPYNMAHNAEAEACDLLMEIERLDLLEQYVDENIYPRVCLYLTSCVPYVADPENTTLLQTALMLFRKFKQYPQALRLAMQLNDHSLIEEIFLNCPDTDVQKQLAFMLGRQQIYIEVPDSTPEYEDLIEIMANCHLNNHFLNLARELDIMDPKTPEDVYKSHLENSRPPFGGSQVDSARQNLAASFVNGFVNAAFGQDKLLMEDGNKWLYKNKEHGMLSATASLGLVLLWDVDGGLTPIDKYLYSSEDHIKSGALLACGIVNCGVRNECDPALALLSDYVLHNTNIMRIGAIVGLGLAYVGSNREAVLSLLTPVFSDPKSNMEVIGMSALACGMIAVGSGNLQVTTTIMQTLMEKSETELKDTYARFLPLGLGLCMLGKQEGIDSIIAALEVIPEPFKSMATTMVDICAYAGTGNVLKVQHLLHICSEHYDGSDSSDKSSKDKDKKDATEKEKDLSSRQAVAVLGIALISMGEDIGSEMAFRTFGHLLRYCEPVIRRAVPLALGLISVSNPKLSILDTLSKFSHDSDAEVAHNAIFAMGLVGAGTNNARLAAMLRQLAQYHAKDPNNLFMVRIAQGLTHLGKGTLTLSPYHSDRQLMSPVAVAGLMATLVGFLDVKNIILGRSHYLLYTLAAAMQPRMLVTFDEDLNPLPVPVRVGLAVDVVGQAGKPKTITGFQTHTTPVLLAYGERAELATEEYLALTPIMEGFVILRKNPDFNA

SEQ ID NO: 11795 - protein, 505 aa, Phyllotreta atra
MTDSNMDSKEEKQASPDNAHLKPEATEPEAPPAQASPAAGVIRRNFITPAGTIVETNEEQPPEPTTEEVVKTTSSNPSPAEQKPEPEIVTYAAEVLPQEQREQFAEAKSYAVEMPAENFPNNNFTQDISYVNIEGTVVPVTISEMEHPGDYANLQTAQYNNGYTDGTQYLTNHQYQNMYIERTTVDNSPSATVLYRDDPNLGASRFQGNYDISSSQSQVNLLPAASGETYYTSTPNWTPTSSGTYQQQYPSGTINVLQADSTQAFGSPYINATWSSNSMEDGRPSSQEVLVKECVNCGASVTPLWRRDGTGHYLCNACGLYHKINGVHRPPTKPTKKPQATGNRRNGVTCANCKTNNTTLWRRNNQGEPVCNACGLYYKLHNVNRPISMKKEGIQTRKRRPKNSSVGNPASAAGQVRLGIPSYPYSEIDVQQDQYQLPMNVYSQRPQVSYRQYGTENIGTLNAQPLQPIITHEDEQASVITSTSQQARFRTKVEEDEGSNPSMQS

SEQ ID NO: 11796 - protein, 1622 aa, Phyllotreta atra
MITMALPGNGIFVVKGEISNLMAAMKRGPKWSSHSYQDDDVDALLRNFQELRDILHNVNDLGYVEPNTFLAPFLNVIRSEETTGPVTSLALSAVNKFLSYGLLDPVQTSIPQTIHTIADAVTHARFVGTDQSSDGVVLMRILQVLRTLTLSPEGATLTNESLCEIMLSCFRICFETRLSELLRKTAEHYLKDMVQLIFMRLPQFSEDPKLSYVKRLRMQPGDLEQTRTKRKKYSKKENKEVAKVPPQEINVESIPQTDIVDMQGTILRNNEVTTPSSPNPNVDTDVAIDIPTDDSMKNSETSTSNLDDSAEKETDEPFQDYVNQRGIRFTPQFQQETNLSPYGLACVRELFRFLISLCNPLDKQNTDVMIHLGLSLLTVAFEISADNIGKYSTLLTLVEDDLCRNLFALMNTDRLTIFAANLQVSFLLFESLRAHLKYQLECYLKKLMEILRSESNKVSYEHKEIALDNLLQLWRVPGFHAELYVNYDCDMYCTNLYEELTELLAERSISTIVGVYHAHLLSLDGLLIIIDGIGKRFDEAKDRTDTDEISSYIGENTRIKGCVKVPDKKVLAAKKGIKKWLPQGTEYFNQKPKKGIQFLQEHGVLKQELDVEEIARFLRENPALNKAMIGEYISNRGNLKILEAFVSTFDFTGIRIDEALRAFLETFRLPGEAPTISLILEHFAEHWHKSNGEPFADVDSAFTLAYAVIMLNVDQHNENAKKQTIPMSPNAFKKNLKGVNGGDDFEEDMLDEIYTSIKSEEIVMPAERTGVVRDNYLWKVLLRKGRSPEGGVYMRDDGGAYDAELFRIAYGPLAAALNSVYERADHEGVQKKVMRGFERCASIASNLGMTSNLDMLLVSLSKFTVFHNHQKQTAVVVQFGSNGKAQLALKTLFMLIHQHGNSTREGWKHLFDLLLALYSNDLLSKSFVEVEDFVEPSGKLCLVYKDAPSAAKQDTGLLSSLYSYMISVENLSKIPSPEEQSLIDKARECIKECNLEQMITDSKFLHQQALFQLVDTLIELSRGPDVQDGSSYDYNENVTVFFLELLVKIVIQNRDRVMTIWDRVRDHVYTLVMNSSLMDYQFLLERSVVGLLRIAVRLMRNEEMSHVVLQSLRMLLLLLKGGVLARISRQMAFGLYEMLKTSAQNIHTTADWTVVFALLECVGAGAKPPRPVLTVEENDAKPKPDEENPPTKDHKKDEEGACAFSDPKTNETAKHPTQRPQSPVTALTSPVGTPNTGGWIIVSDEDDLQPHRGPQQTLPVHYHLRLDADLSPHDPLSMLKCCESLAFLVRDVAHITPYNFDVCVRCVRTFVEAALKPPTNNHPNTRRSNVKKSRKKSPAGSQEEDSSGGDEDEDLPSGYHQVPIQLLDLMHTLHTRTAQIFKWWAEEGGEISGETSLWAQGWCPLLQGIARSCCDIRRTVRTSAIAYLQRALLVHDLQTLTPKEWEQCFRRVLFPLMNYLLQSTSPRDAVSTEETRIRAAGVLSKVFLHHLAPLSSLAGFADLWSTVLELMDGYMHADGSELLLEAVPESLKNMLLVMEAAGVFDGPDGKKNALWAATWERIGKFLPGLKDELFREMGSRRKVVEEVKDVEVGEKETECWEKNVGEREQDVDGREKEELVAC

SEQ ID NO: 11797 - protein, 205 aa, Phyllotreta atra
MSILAYNGGAMVAMKGDNCVAIAADRRFGIQAQTVATNFEKVFEMGPHLFVGLPGLATDTQTVMEKLRFRKNLYELKENRRISPKVFAAMISNMLYEKRFGPFFVEPVVAGLAPDTFEPYICNMDLIGCINEPSDFVVGGTASAQLYGMCESLWEPNLAPDDLFETISQALINAFDRDAISGWGATVYIVEKDKVTVRNLKTRMD

SEQ ID NO: 11798 - protein, 968 aa, Phyllotreta atra
MEGKPELEVVKSAVSTLYNNPDGGEKERASRWLLELQKSVHAWTVADELLRRCTNADDLQTRYFAAQTMRTKIHQSFHELPREVHESLRDSLLEHMGACAGVDEGAGAAIVTQLSLALADLALQMPDWRTPALDLIGRFSAGNNVWPLLEVLTVLPEELESRSVRLGENRRYEVLEDMKFCAPTVNEFLKHCSNLYGRGGAERLAAGDRQIDVKILRCFASWISVGAIGPSQLSEDRVVVDMAFDVLKAAVRGDEKETLTGQLHEAATDCICTLLLRLEDNNNHVALETHLFENIVNLEVAYHASVALEDQAKSTDYCRLFTELAESFLGKIVDDGGGGGGGDGGGAKRRTVYAVKCLDLVLMCVGHHDYEVAEITFNLWHMLSEELYQKNNKELTELFKPYVERLITALCRHCQMEPDMEGLLEKGDEFKDFRMKVSDLIKDVVFIVGSSSCFRQMFINLQTTGVTWDASEAALFVMQAVAKNVLPTENEVVPKVVEAILNIPNSAHVAVKYTSVLLLGELAEWIEKHPDALDPVLNFLVCCLRGGSGAEGGGVATAASAALQNVCTCCGAHMGRHVPILLQLLQQSDTFGIGNTAVVGLLKGVASVVSCGMGGGAETASAVRELCSMQLSPLCSLMENDVRPVKGTLTDPVLWLDRLSSVLRYVNVNIVEGEIHPCKPVILEIWPILSRAFDTYHSDVRIMERCCRSVRFMLRCVARQLQDLLPSLVGQIVHIYCRYGHSCCLYVGSILVDEYAGDATCVQGLLDMLNAFLEPTFRLLQEENGLKNHPDTVDDFFRLCARFVQRAPKAFLSGGAHLAPIMQCALLAATLDHKEANVSVMKFFYDLINQGLSGRGEPDFDERKALVRSLLNEYGQQLVSNLIHSCVFYLHSYMLSEVGDVFVQLLDFDRQITSEWLANGLELLPKQQNGGIMAAKPKQLNDVHASITRSNSSKSVTHALKDLTRLYR

SEQ ID NO: 11799 - protein, 502 aa, Phyllotreta atra
MAQRFPGPVSNQVPGGPPPPQRYQQQPPNQGMRQYGQQSFPPRPGYNPPPPNMQSSGGTMIQRPPGAPYSPMRGGPMPPQPVGKRPSDNRNPLQQKNSDYSHGTSKKKKKLADKILPQKVRDLVPESQAYMDLLAFERKLDSTIMRKRLDIQEALKRPMKQKRKLRIFISNTFYPAKEPQPEGPDGPCQEGTVASWELRVEGRLLEDSKNDPNKVKRKFSSFFKSLVIELDKELYGPDNHLVEWHRTLTTQETDGFQVKRPGDKNVRCTILLLLDYQPLQFKLDPRLARLLGVHTQTRPVIISALWQYIKTHRLQDGHEREYIICDKYLEQIFNCTRMKFAEIPQRLNPLLHPPDPIVINHVISVEGGAESKQTACYDIDVEVDDTLKTQMNNFLLSTASQQEIQGLDAKIHETVDTINQLKTNREFFLSFAKDPQQFIHKWIVSQTRDLKSMTDVVGNPEEERRSDFFYQPWAQEAVCRYFYTKVQQKRAELEQALGIRNN

SEQ ID NO: 11800 - protein, 144 aa, Phyllotreta atra; identical to SEQ ID NO: 11684

SEQ ID NO: 11801 - protein, 294 aa, Phyllotreta atra; identical to SEQ ID NO: 11575

SEQ ID NO: 11802 - protein, 403 aa, Phyllotreta atra; identical to SEQ ID NO: 11576

SEQ ID NO: 11803 - protein, 533 aa, Phyllotreta atra
MTAPAAGGDARGRTLAYKDKSKPADVRTSNINAAKAVCDAIRTSLGPRGMDKMIQAGNGEVTITNDGATILKQINVIHPAAKMLVELSRAQDIEAGDGTTSVVVIAGALLDAAEKLLQRGIHPTAISESFQRAAHLAVEILQEISTPVEITNRELLIKSASTSLNSKVVSQQSSLLGPLAVDAVLKIVEPGQEQACNLLDVKVIKQLGGTVEDTELIEGIVFSQKSANVSGPKRIEKAKIGLIQFCISPPKTDMDHNVIVSDYAAMDRVLKEERAYILNIVKQIKKAGCNVLLVQKSILRDAVSDLALHFLDKIKCMVVKDIEREDVEFVCKSLGCRPIASLDHFTAENLVTADLVEEVGVGGNRMVKITGIQNAGRTVTLLVRGSNKLVLEEAERSLHDALCVIRCLVRKKALIAGGGAPEIEVALKLAAMANKLEGIDAICTRAYATALEIIPFTLAENAGLNPIQTVTELRNRHAKGETSAGINVRKGTITDILEENVVQPLLVSTSALSFATETVRSILKIDDIVNTIT

SEQ ID NO: 11804 - protein, 409 aa, Phyllotreta atra
MEAMEIVIPEKEEGSPAEVKQGRQELDMEDLYTKYKKLQQTLEFLEVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVQYSDIGGMDMQKQEIREAVELPLTHFELYKQIGIDPPRGVLMYGPPGCGKTMLAKAVAHHTTAAFIRVVGSEFVQKYLGEGPRMVRDVFRLAKENSPAIIFIDEIDAIATKRFDAQTGADREVQRILLELLNQMDGFDQTTNVKVIMATNRADTLDPALLRPGRLDRKIEFPLPDRRQKRLIFSTITSKMNLSEEVDLEDYVARPDRISGADINAICQEAGMHAVRENRYIVLPQDFEKGYKNYIKNDESEHEFYQ

SEQ ID NO: 11805 - protein, 162 aa, Phyllotreta atra; identical to SEQ ID NO: 11350

SEQ ID NO: 11806 - protein, 309 aa, Phyllotreta atra; identical to SEQ ID NO: 11464

SEQ ID NO: 11807 - protein, 533 aa, Phyllotreta atra
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDSIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVESSDTIENVKAKIQDKEGIPPDQQRLIFAGKQLEDGRTLSDYNIQKESTLHLVLRLRGGM

SEQ ID NO: 11808 - protein, 540 aa, Phyllotreta atra; identical to SEQ ID NO: 11582

SEQ ID NO: 11809 - protein, 3615 aa, Phyllotreta atra
MGDSLEASETAHETQNVALVDFTAFSNFILKAATVLLPEDDSQAEPANLIAAIDDKTNQECIKKFISDPQIVILYVQRNSSKDDDNVQPPEGEEEKEPVTYYISNEVHYSNSKMSSLVCIKRGPVIEADKSIRAQVRLMNFSEGSPYEILHDYVSRTVAPYFKSYVKESGRADRDGDKMAPAVEKTIAELEMGLLHLQQNIDIPEITLQVHPYVASLIKQCADEGRKPKVADFSDKVDDSNFLNQLQHGVNRWIKEIQKVTKLDRDPSSGTALQEISFWLNLERALHRIQEKRESMEVALTLDILKHGKRFHATVSFDTDTGLKQAIATVNDYNPLMKDFPINDLLAATELERIRAAVQMIFSHLRKVRSTKYPITRCLRLVEAISRDLGMQLLKVLGTRRLMHIPFDEFEKVMTQCFEVFSIWDDEYEKLQGLLRDIMKKKRDEHMKMVWRISPQHKKLQSRMDQMRKFRRQHEQLRTVIVRVLRPSVKESAVPVEGSDIEPPKPTFSLDAADANAIEEVNLAYENVKEVDCLDITKEGQDAWDAAVQRYEERIDRVETRITAHLRDQLGTAKNANEMFRIFSRFNALFVRPHIRGAIREYQTHLIQRVKDDIEALHEKFKVQYPQSNSAKISKVRDLPPVAGSIVWAKQIDHQLTTYLRRVEDVLGKGWENHIEGQKLKADGDSFRLKLNTQEIFDDWARNVQQRNLGVSGRIFTIEAVRSRSGRGNVLKLKVNFLPEIITLAKEVRNLKCLGFRVPLAIVNKAHQANQLYPFAISLIESIRTYEMTLEKIEDKASIIPLVAGMRKEVQLVLAEGIQLVWESYKLDLYVQRLSDLVVGFQERVEELVFVGEQLEVDVRSLETCPYSANTFADILSKIQHAVDDLSLKQFSNLHIWVLRLDEEVEKNLARRLQAGVEAWTEALSGQKKEIDHSMDTDAPAQPTHKPGGDPQIQTMIHEVRITNQTMYLFPSIEEARFLIMQQLFAWQAIVTCQQRLQSSRYQVGVDKPVVETYRNILTRLPAGAQPLINAYSAISSKIKEVQNYVNEWLTYQSLWDLQADNLYGKLGEDISKWMECLNDIKKTRTTFDTSDTRREFGPIVIDFAKVQSKVSLKYDSWHKETLSKFGSLLSNEMTSFHSNVSKSRSDLELQSIEAASTSDAVSFITYVQQLKRNMKAWEKQVDIYKEGQRILERQRFQFPTNWLHVENLEGEWGAFNEIIKRKDSSIQTQVASLQQKIVSEDKAVESRTNDFLVDWERSKPVEGHLRPDDALSQLQLFESKFSRLKEERDNVAKAKEALDLQDPGGISTSEDKMQVVYEELQDLRGVWSELSRIWQQIDETREKPWLSIQPRKLRQQLDQLSTQLRELPARLRQYASYEYVKKTLQTYTKVNMLIVELKSDALKERHWKQLMKQLRVNWVLSDLTLGQVWDVNLQKNEMIVKDVILVAQGEMALEEFLKQVRESWQNYELDLINYQNKCKLIRGWDDLFNKVKEHINSVAAMKLSPYYKVFEEEASTWEEKLNRINALFDVWIDVQRRWVYLEGIFSGSADIKTLLPVETSRFQSISSDFLGLMKKVSKSPMVMDIVNILGVQRVLERLADLLGKIQKALGEYLERERTSFPRFYFVGDEDLLEIIGNSKNVARLQKHFKKMFAGVASILLNDNNTVITGIASREGEEVVFKTPVSTVEHPKINEWLSLVEKEMRVTLASNLTQAVQDIKQFKDEIDSKSYMEWVDKYQAQIVVLAAQILWSEDVEAALVKMNSEPQRGVLEKVLQQVENTLNVLADSVLQEQPQLRRKKLEHLINEFVHKRTVTRRLIANGVCSNKAFEWLCEMRFYFDPRQTEVLKQLTIHMANARFYYGFEYLGVQDRLVQTPLTDRCYLTMTQALEARLGGSPFGPAGTGKTESVKALGNQLGRFVLVFNCDETFDFQAMGRIFVGLCQVGAWGCFDEFNRLEERMLSAVSQQIQTIQEALKSQMEAAAEGVATGSISVELVGKQVKVSPDMAIFITMNPGYAGRSNLPDNLKKLFRSLAMTTPDRQLIAEVMLFSQGFRQAEKLASKIVPFFRLCDEQLSNQSHYDFGLRALKSVLISAGNVKRDRIQRIKEGMTQRGETNIDEANIAENLPEQEILIQSVCETMVPKLVAEDIPLLFSLLNDVFPNVQYTRAEMEGLKDEIRKVCNEEYLVCGEGDERGSAWMEKVLQLYQISNLNHGLMMVGPSGSGKSSAWRVLLKALERFEGTEGVAHVIDPKAISKETLYGVLDPNTREWTDGLFTHILRKIIDNVRGEINKRQWIIFDGDVDPEWVENLNSVLDDNKLLTLPNGERLSLPPNVRVMFEVQDLKYATLATVSRCGMVWFSEDVLSTEMIFENYILRLRNIPLEESEEGFGKKSDMKDDMLSPTLQLQLDVVNLLQPFLGPDGLVVRCLEYAMEQEHIMDFTRLRALSSLFSMLNQAVRNVLQYNHMHPDFPLSSEALDKYIPKCLIYSILWSFAGDAKLKVRSELGDFIRSVTTVPLPSDRNLPIIDYEVTIEGEWSLWSNKVPQIEVETHKVASPDIVVPTLDTVRHESLLYTWLAEHKPIVLCGPPGSGKTMTLFSALRALPDMEVVGLNFSSATTPELLLKTFDHYCEYRKTPNGVILSPIQLGKWLVLFCDEINLPDMDNYGTQRVIMFLRQIVEQKGFYRASDQTWVSLERIQFVGACNPPTDPGRKPLSHRFLRHVPVVYVDYPGETSLKQIYGTFTRAMLRLAPGLKGYAEPLTNSMVEFYLSSQDRFTQDMQPHYVYSPREMTRWVRGICEAIRPLDNLSVEGLVRLWAHEALRLFQDRLVEDTERRWTNENIDAVALKHFPSADCEKALERPILYSNWLSKDYVPVGREQLREYVKARLKVFYEEELDVPLVLFDEVLDHVLRIDRIFRQPQGHLLLIGVSGAGKTTLSRFVAWMNGLSIFQIKVHNKYTADDFDEDLRSVLRRSGCKHEKIAFILDESNMLDSSFLERMNTLLANGEVPGLFEGDEYTTLMTQCKEGAQREGLMLDSNDELYKWFTQQVMRNLHVVFTMNPSTDGLKDRAATSPALFNRCVLNWFGDWSDGALFQVGKEFTNRLDLEKQSWKCPDFFPASCNNISASPNHREAVINACVYVHQTLHKANSRLVKRGSRTMAITPRHYLDFIHHLVKLYNEKRSDLEEQQLHLNVGLNKIAETVEQVEEMQKSLAVKSQELQAKNDAANAKLRQMVKDQQEAEKKKVQSQEIQQQLAQQTVHIKQKKSEVMADLEQVEPAVIEAQQAVKSIKKQQLVEIRTMANPPALVKLALESICLLLGENASDWKSIRAVIMRDNFINSVVNFNTEDISDDVREKMKGRYLSNPDYQIDKIYHASNACGPLVKWACAQVEYADMLKKVEPLREELQSLETQAETNQKRGEDVKVLIGQLEQSIASYKEEYAQLIAQAQAIKTDLENVQAKVDRSIALLKSLVIERERWEASSETFRSQMSTIIGDVLLSAAFIAYGGYFDQHYRQNLFSTWCQHLTLANIQYRADIARTEYLSNPDERLRWQANALPSDDLCTENAIMLKRFNRYPLIIDPSGQATEFIMNEFKDKKITKTSFLDDSFRKNLE

SEQ ID NO: 11810 - protein, 890 aa, Phyllotreta atra
MSRQGPSKRYDSDSDSDSVDSAEEARKRDLQERDEFANRLKKRDEDRTRNVVQNFDKRTYEEAAKRLKLDNAGRDKVISELRKTSRWKYLEKRKDDKLQELEADIVDDEYLFEEEILTEREKKERQHKKELLQLAQEHEKARELERIQRYHMPRDLGKDSTADYIEVDELEKVPQSEQKKWEKDQMASAVFKFGAKDVKKTDDYELLLEDQIDFIQALQMPGSSEKKVPELSDVQKKKLTIEETKKSLPIYPFRDDLIQAVKEYQVLIIKGETGSGKTTQIPQYLHEAGFTADGKKIGCTQPRRVAAMSVAARVAQEMDVKLGNEVGYAIRFEDCTSERTVIKYMTDGTLHREFLSEPDLQSYSVMIIDEAHERTLHTDILFGLVKDIARFRPDLKLLISSATLDVTKFSEFFDDAPVYQIPGRRFPVDIYYTKAPEADYVDACVVSILQIHVTQPLGDILVFLTGQDEIETCHELLQDRVRCLGSKVKELIILPLYANLPSDLQAKIFEPTPPGARKVILATNIAETSLTIDNIIYVIDPGFAKQNHFNSRTGMESLMVVPISKASANQRAGRAGRVAAGKCFRLYTAWSYKHELEETTVPEIQRINLGNAVLMLKALGINDLVHFDFLDPPPHETLVLALEQLYALGALNHHGELTKLGRRMAELPVDPMMAKMILASEKYKCSEEIVTIGAMLSVNGAIFYRPKDKIIHADTARKNFNHLAGDHLSLLNVYNQWRDSDYSLQWCYENFIQHRSMKRARDVREQLVNLMTRVEIEIVSGIDETDNVRKAITSGYFYHIARFSKGGSYKTVKHNQSVTIHPNSALFETLPRWILYHELVFTTKEFMRQVIEIESKWLLEVAPHYYKAKELEDSTNKKMPKTVGRSKMTD

SEQ ID NO: 11811 - protein, 456 aa, Phyllotreta atra
MKVEEVKSTVKTQRISAHTHIKGLGLDEGGFAIPSAAGLVGQEQAREAAGVVVDMIRSKKMAGRAVLLAGPPGTGKTAIALAIAQELGNKVPFCPMVGSEVYSTEIKKTEVLMENFRRAIGLRIRETKEVYEGEVSELTPVETENPAGGYGKTVSHVVIGLRTAKGSKQLKLDPSIYEALQKEKVEVGDVIYIEATSGAVKRQGRSDAYATEFDLEAEEYVPLPKGDVHKKKEVVQDVTLHDLDAANAKPQGGQDVLSMMGQLLKPKKTEITDKLRKEINKIVDKYIDQGIAELVPGVLFIDEVHMLDIETFTYLHRALESAIAPIVIFATNRGRCLIRGTDDVFSPHGIPLDLLDRLLIIRTIPYNKSEMEQIIKLRAVTEGLEIDQEAISSLGEVGTKATLRYAVQLLTPSFLTAKINGRSNILQSDVEEIGCLFLDAKSSAKILTEHKDKFMT

SEQ ID NO: 11812 - protein, 518 aa, Phyllotreta atra
MTSIIKVQALSGAKDESPPCYLLQVDDVRILLDCGWDEKFDMEFIKELKRHVHTIDAVLISYPDNYHLGALPYAVGKLGLNCPIYATIPVYKMGQMFMYDLYQSQYNMKEFCIFSLDDVDATFEKVIQLKYNQTVPLKGKGYGITVTPLPAGHMIGGTIWKVNKVGEEDIVYCNDFNHKKERHLNGCELKKLQRPSLLITDAFNATYQQARRRARDEKLMTNILQTLRNHGNVLIAVDTAGRVLELAHMLDQLWRNKESGLLAYSLAFLNNVSYNVVEFAKSQIEWMSDNLMRSFEGARNNPFQFKYLQLCHSLGELSKVPSPKVVLASSPDLESGFSRELFLQWCSNPNNSIILTTRTSPGTLARDLIDNGGGRTIDLIVERRVKLEGQELDDYERRQRSKYDKLEEDEADSDSDSDIEMSVTSKGKHDIVIKQEGKISTGFFKVTKKMYPMYPFKEDKIKSDEYGEIVKAEDYKLAEISAEGEDNKENIVIKKEEEEISKYYSFMNDLIVTLIIFS

SEQ ID NO: 11813 - protein, 755 aa, Phyllotreta atra
MPPLEVTGNTNNDESAPINPVVGIIYPPPEVRNIVDKTASFVARNGPEFEARIRQNELGNPKFNFLNGGDPYHAYYQHKVKDFREGKGQEPTPGLSQAVAKLSVSASAQQKQQEILKQVEQPFVPKDPPSEFEFIADPPSISALDLDIVKLTAQFVARNGRAFLTQLMNREQRNFQFDFLRPQHSLFQYFTKLLEQYTKVLIPPKSMEQRLRDEAKSAKAVLEQVKYRAEWLRYQEQQKAKEEEILERERVAYAQIDWHDFVVVETVDYQPFEIGNFPPPTTPEEVGARILIQERIEEGEDIEMQLESDEDDDTNADDGLSSMQDKTKRKGGDDNRLQDMEEDTSDEDNDDDGGKTGPSSSLIQPPLPPIPDKVLVKKYDPKQAVKVSRPTVGDDYLVSPITGEKIPASKVQEHMRIGLLDPRWVEQRDKQMSDKMNQDTVYAAGSAIDASLKLLAERRTDIFGVGDEETAIGKKIGEEDVRKDEKVTWDGHTSSVEAATRAARANITLEEQIHQIHKVKGLLPDEEKEKIGPKNIGSKKINIQSVITTKPANQAAQQPKPPVSMIQTGAQPIIPTQPAMLAPQPSIMMMPAPPMPTIRPPPLMMPGGVAMGGYPVGPMPPGPGMNMAPMKHPNEGPSEDEPSNKKLRNEDSLVPENVFLSRNPSQVSIKISIPVMPEKSEWRLKGQMVSWTLALTESVSNLKAKIQEETNMPPAKQKLFFDGMFFKDSNTLAYYNVTQGAVIQLQIKERGGRKK

SEQ ID NO: 11814 - protein, 325 aa, Phyllotreta atra
MPSTEVTTTKVIVHPLVLLSVVDHFNRMGKIGNQKRVVGVLLGCWRAKGVLDVSNSFAVPFDEDDKDKSVWFLDHDYLENMYGMFKKVNARERVVGWYHTGPKLHQNDIAINELVRRYCPNSVLVIIDAKPKDLGLPTEAYQAVEEVHDDGSPTSKTFEHVPSEIGAEEAEEVGVEHLLRDIKDTTVGTLSQRITNQLLGLKGLHLQLKDIRDYLMQVCDNKLPINHQIIYQLQDIFNLLPDINQDAFNNSFYVKNNDQMLVVYLGALVRSIVALHNLINNKLTNRDAEEGKKEEKKDNKDKDSKDKDKEKTDKEKEAKKDEKKK

SEQ ID NO: 11815 - protein, 519 aa, Phyllotreta atra
MLKMLMDPMGGIVMTNDGNAILREITVQHPAAKSMIEIARTQDEEVGDGTTSVIVLAGEMLAAAEQFLEQQIHPTIIIRQYRQALEDMVQFLEGPLSVPLDRNDKNAVAQVVKGCIGTKFLSKWSDLAVNIALDAVNTVLLEENGRTEVDIKRYAKVEKIPGGSVEESRILRGVMLNKDVTHPKMKRHIKNPRIVLLDCALEYKKGESQTNVEISTETDFTKLLELEEEHVKRQCDEIIALKPDVVFTEKGVSDIAQHFLLKAGITAIRRVRKSDNNRIARACGAVIVNRTEELQESDVGTGAGVFEIKKFGDEYFCFIDECKNPKACTILLRGASKDILNEIERNLQDALQVARNIVLSPRLVPGGGAIEMAVAQRLMQKATHGPYRALAHALEIIPRTLAQNCGANTIRTLTALRAKHANHAEADKPCTWGIDGESGELVDMKIKGLWEPLSVKLQTYKTAVETAILLLRIDDIVSGSKKKGDKEVPTPSQMQQQETQGGDSTFGFSNLFSFLSLVI

SEQ ID NO: 11816 - protein, 233 aa, Phyllotreta atra
MMQTGIRPYYPDYSTIPVERQINPYADNGGSVVAIAGKDFVVIGADTRLSSGFSIYTRNQNKLFPLSETTVLGCSGCWCDTLTLTRIIKSRMQMYYQEHNKNMSTTAAAQMLSTMLYYKRFFPYYISNILVGLDNEGKGCVYSYDPVGHCEKATYRAGGSAGALLQPLLDNQIGQKNPQKPSQEDLTQEKAISTLKDVFISAAERDIYTGDSVLIKIITKDGMKEETFELRKD

SEQ ID NO: 11817 - protein, 299 aa, Phyllotreta atra
MFQFGFNMFPDIPRPFNMTYKCYSVAMFPGNERQDVERGGKIIMPPSALEQLTRLNINYPMLFKLVNKKTNRTTHCGVLEFVADEGKVYLPLWMMHNLVLTEGDLVQMESVSLPVGTFSKFQPLNPDFLDITNPKAVLENCLRSFACLTTGDVIAVRYNQKAYELCVLETKPGNAISIIECDMNVEFAAPVGYKEPEQAKKEEEMSVDPADLMPEPSGFVAFRGAGVRLDGKKRKDSSSNDTPSVKPVYVRGIPDYDYQIGTLDFIRRTVAKPKEKENSEDGDDFKAFSGTGFSLRSRN

SEQ ID NO: 11818 - protein, 540 aa, Phyllotreta atra
MSALPGAIAFDEYGRPFIILRDQDKQKRLTGIDALKSHILAASQIAHTVRTSLGPKGLDKMMVSSDGEVTVTNDGATILKMMDVEHEVAKLLVQLSQSQDDEIGDGTTGVVVLAGALLEQAGALLDRGIHPIRIADGFELACQTAVDHLEKIAELFPVSAENTEPLVKVAMTTLGSKIINKCHRQMAEIAVNGVLAVADLQQKDVNFELIKVEGKVGGKLEDTTLVKGVVIDKTMSHPQMPKELKNVKLAILTCPFEPPKPKTKHKLDVTSVEDYKELRLYEQEKFKEIVGLVKKAGATLAICQWGFDDEANHLLLQQELPAIRWVGGPEIELIAIATGGRIVPRFEELSPEKLGSAGLVREISFGTTKDKMMVIEECSNSRAVTILVRGGNQMLVDEAKRSLHDALCVVRSLIQEPRVVYGGGAAEIACSLAVAAQADQLASLEQYAYRAFAEALESIPLALAENSGFSAIHTLGEIKAKQAASGDPALGVDCMNIGNINMREQHVTESLRSKRQQLLLATQLVKMILKIDDVRQPGSG

SEQ ID NO: 11819 - protein, 116 aa, Phyllotreta atra
MAAASAMDVDDDDEVELPTSSSSKGEKKRFEVKKWNAVALWAWDIVVDNCAICRNHIMDLCIECQANQAAATSEECTVAWGVCNHAFHFHCISRWLKTRQVCPLDNREWEFQKYGH

SEQ ID NO: 11820 - protein, 534 aa, Phyllotreta atra
MVSLNPVRILKHDAEDERAEIARLSSFVGAIAIGDLVRSTLGPKGMDKILVSSGRNSGMVEVTNDGATILKSVGVDNPAAKILVNMSKVQDDEVGDGTTSVTVLASELLKEAERLIEQKIHPQTIIAGWRKAVDIARKALLDASTDNSANLEAFREDLMNIARTTLSSKILSQHKEHFAKLAVDAVLRLKGSGDLQAIQLIKKTGGTLQESFLDDGFLLDKRPGVHQPKRVENAKILIANTPMDTDKIKVFGSHIKVDSMAKIAELESAEKDKMKDKVNKILKHNANVFINRQLIYNYPEQLFADAGVMAIEHADFDGIERLALVTGGEIVSTFDHPELVKLGTCDLIEQIMIGEDTLLRFSGVALGEACTIVIRGATQQIIDEADRSLHDALCVLAATVKESRIVFGGGCSETLMATAVARASVNTAGKEALAMDAFARALLQLPTIIADNAGYDSAQLISELKAAHNSGLNTMGLNMEKGELGDMRALGITESFVVKRQVLISAGEAAEMILRVDNIIKAAPRQRTEDRGMC

SEQ ID NO: 11821 - protein, 280 aa, Phyllotreta atra
MFRNQYDSDVTVWSPQGRLHQVEYAMEAVNLGSATVGLKSASHAVIIALKRASSELSAYQKKIIQIDDHIGITISGLTADARILSRYMRNECLNYKYSLDAYMPLNRLINILGIKMQHCTQRYDRRPFGVGLLVAGCDDNGAHIYQTCPSANFYNCKAMSIGARSQSARTYLEKKLDELPSCSLEDLIKHGLRALRDTLPPEVDLNTKNVSIGYVGKGITFKILEEEETAPYLALIEGEERRGGAGGGGGSSEGQADPLRESGDDGPKDPVPAVAMDTTE

SEQ ID NO: 11822 - protein, 847 aa, Phyllotreta atra
MGLKPGNNQEPMEITFHDDDLPYEEEILRNPYSVKHWLRYIDHKKTAPNNEMNIIFERALKELPGSYKLWYNYLRTRRNQIKSKCITDPGFEEVNNAFERSLVFMHKMPRIWMDYCTFLTDQCKITRTRKVFDRALRALPVTQHNRIWPLYLKFVQKHDISETAVRVFRRYMKLCPENAEEYIDYLTKVERLDEAAIITAKIVNDDNFVSQQGKSKHQLWNELCELISKNPEKVRSLNVDAIIRGGLRRYTDQLGHLWNSLANYYVRSGLFERARDIYEEAIQTVTTVRDFTQVFDAYAQFEELSLSKRMEEVATKQNPSEDDDTELELRLARFEYLMERRLLLLNSVLLRQNPHNVQEWHKRVQLYEGKPHEIINTYTEAVQTVDPKLAVGKLHTLWVEFAKFYESNDQIEEARLIFEKASQVPYVKVDDLATVWCEWTEMEIRNENYDEALKLMQRATVMPSRKVAYHDDTETVQSRLYKSLKVWSMYADLEESFGSFKSCKAIYDRIIELKIATPQIIINYGVFLEENNYFEEAFRAYEKGISLFRWPNVYDIWNTYLTKFLKRYGGSKLERARDLFEQCLDGCPPQFAKHLYLLYAKLEEEHGMARHAMAVYERSTKAVPENEMFDIFNIYIKRAAEIYGIPKTRQIYEKAIEVLPEDKTREMCLRFADMETKLGEIDRARAIYAHCSQICDPRVTAEFWQIWKEFEVRHGNEDTMREMLRIKRSVQAVYNTQVNMMSAQMLSSAGSSSGTIADLAPGVKDGMRLLEAKAAEMAGSVAQKPNIMFVRGETQGDKKDKVVNPDEIDIGSEDEEEEEEEISVEKQNVPSEVFGSLKKKGADDEDD

SEQ ID NO: 11823 - protein, 370 aa, Phyllotreta atra
MANGPIAERNRDATIYVGGLDDKVSESLLWELFVQAGPLVNVHMPKDRVTMMHQGYGFVEFMGEEDADYAIKIMNMIKLYGKPIRVNKASAHQKNLDVGANIFIGNLDPEVDEKLLYDTFSAFGVILQTPKIMRDPETGNSKGFAFINFASFEASDASIEAMNGQYLCNRPISVSYAFKKDSKGERHGSAAERLLAAQNPLSQADRPHQLFADAPPIGMMPMSMAPPPPPLITGMMPPPPPTPGGMPPPPPPVPPPSSFPAGIPPPPLPPSQPPLPPGAPPAMAAVQGGAARPPPPPPWSAAAANVPMPPGPPASNAGGGFGGMLPPPPPPGGRPMPPNWRPPPPPPNFGGARPPFPPRGPPPPPPTFEG

SEQ ID NO: 11824 - protein, 257 aa, Phyllotreta atra; identical to SEQ ID NO: 11369

SEQ ID NO: 11825 - protein, 136 aa, Phyllotreta atra
MARTKQTARKSTGGKAPRKQLATKAARKSAPATGGVKKPHRYRPGTVALREIRRYQKSTELLIRKAPFQRLVREIAQDFKTDLRFQSSAVSALQEASEAYLVGLFEDTNLCAIHAKRVTIMPKDIQLARRIRGERA

SEQ ID NO: 11826 - protein, 530 aa, Phyllotreta atra
MAISLLNPKAEVARAAQALAVNITAAKGISEVMKTNLGPKGTMKMLVSGAGDIKITKDGNVLLHEMQIQHPTASLIARASTAQDDMTGDGTTSTVLVIGELLKQADIYIAEGLHPRTLTEGFDKARAKALEVLEKLKVPIEVNKESLTDVCRTSLRTKLHQKLADLLTDVCVEAILAIKQSDKPVDLHMVELMEMQHKTETDTQLVKGIVMDHGARHPDMPKSLKNCYILTCNVSMEYEKSEVNSGFFYKTAEEREKLVLAERDFIEQRVKKVVELKKALCNGTNKSFVVINQKGIDPMSLDMLAKEGIVALRRAKRRNMERLALACGGIAVNSFDDLQESHLGYAGHVYEHVLGESKYTFVEDCKVPQSVTILIKGPNKHTLMQIKDAVRDGLRAINNAIDDKALIPGGGALEVAVNKELLAYKDEIKGKSRLGVAAYAEALLVIPKTLAVNSGFDAQDTIVKLQEEARLSTEPIGLDLTSGEPINPKDAGIYDNYVVKKQILNSCSIIASNLLLVDEIMRAGMSSLKG

SEQ ID NO: 11827 - protein, 1041 aa, Phyllotreta atra
MSSAGIADSPIDPPAKKRKLDSKNCSPDMANNEASGSSNAGEIDEGLYSRQLYVLGHDAMRRMATSDVLVSGLGGLGVEIAKNVILGGVKSVTLHDDAVCTVRDLSSQFYLTEADVGKNRAEACCKHLSELNTYVPTRAYTGPLDEKVIQKYRVVVLTNSTRAEQLRISEITHNNDVALIVADTKGLFAQVFCDFGKAFSVVDINGEPPVSTMIADISNDTESVVTCIDDTRHGMEEGDYVTFSEILGMTELNNCKPIKIKVLGPYTFSIGDTTKFSKYVRGGIVTQVKMPKEVHFKPLKESLQNPEFVVTDFAKFDHPIQLHLAFSTLHKFVEKTGRLPKPWNKDDATEFIALAKSLAVNGSTDTEVNTDILNIFSKCCSGDLNPINATIGGIVAQEVMKACSGKFYPIYQWLYFDAIECLPQDKEEITEELAAPVDSRYDGQIAVFGKDFQKRLGELKYFIVGAGAIGCELLKNFAMMGIGTQGGQVTVTDMDLIEKSNLNRQFLFRPHNVQQPKSATAAKVIKKMNPDVNIVAHENRVGPETENVYNDEFFEVLDGVANALDNVDARIYMDRRCVYYRKPLLESGTLGTKGNTQVVVPFLSESYSSSQDPPEKSIPICTLKNFPNAIEHTLQWARDNFEGLFKQNAENASQYLRDPDFIERTVKLPGVQPLEVLESVKAAIIDERPKDYDDCLAWARLHWEDQYANQIKQLLFNFPPDQLTSTGQLFWSGPKRCPEPLVFDINEDLHVDYVIAAANLKAQVYGIPTNRNRCYAKQVVTSIEVPEFVPKSGVKIAVTDSQMAMNGNNVDLDRINQIKQELPSMQELSGLTLTPLEFEKDDDSNFHMDFIVAASNLRAANYKIPMADRHKSKLIAGKIIPAIATTTSVVAGLVGLELYKLARSIKSLTPFKNGFVNLALPFFGFSEPIAAPKMEYCGNQWTLWDRFEVQGEMTLAEFLEYFKEKHGLEITMLSQGVCMLYSFFMPKAKAQERLGLTMSEVVRRVSKKKIEPHVRALVFELCCNDADGEDVEVPYVKYNLY

SEQ ID NO: 11828 - protein, 406 aa, Phyllotreta atra
ANENNSTEVQKKGVKGTYVSIHSSGFRDFLLKPEILRAIADCGFEHPSEVQHECIPQAVIGMDILCQAKSGMGKTAVFVLATLQQLEPTENVVYVLVMCHTRELAFQISKEYERFSKYMSNIKVGVFFGGLPIQKDEEVLKNSCPHIVVGTPGRILALVRSKKLNLKHIKHFILDECDKMLELLDMRRDVQEIYRNTPHEKQVMMFSATLSKEIRPVCKKFMQDPMEVYVDDEAKLTLHGLQQHYVKLKENEKNKKLFELLDVLEFNQVVIFVKSVQRCVALAQLLTEQNFPAIGIHRGMEQKERLSRYEQFKDFQKRILVATNLFGRGMDIERVNIVFNYDMPEDSDTYLHRVARAGRFGTKGLAITFVSEEGDAKILNEVQDRFDVNITELPDEIDLSSYIEGR

SEQ ID NO: 11829 - protein, 485 aa, Phyllotreta atra
NSFTEIREQAKQIEKGIINKRDKDLNSFTEIREQAKQIEKGIINKENRFILRVLRCMPNTRRKLNGIVLRSLINQIYPVVERDVLLSFIEESAGELDQTQTKARPATKSPVAEIDTYINLLCLVHLIDTNKLAEAERCSQILMNKITSQNRRTLDLVAAKCYFYYSRVAELTDKLDSIRGFLHSRLRTATLRNDFEGQAVLINCLLRNYLHYSLYDQADKLVNKCVFPETASNNEWARFLYYLGRIKAARLEYSVAHKHLIQAMRKAPQNTAIGFRQTVQKLTVVVELLLGDIPERQIFRQASMRHSLAPYFQLTQAVRMGNLQRFGEVLENFGPQFRLDHTFTLILRLRHNVIKTAIRSIGLSYSRISPQDIAKKLGLDSAEDAEFIVAKAIRDGVIEATLDPQGGYMRSKESTDIYCTKEPQLAFHQRISFCLDLHNQSVKAMRYPPNAYGKELESAEERREREQQDLELAKEMAEDDDDSFP

SEQ ID NO: 11830 - protein, 555 aa, Phyllotreta atra
MAASHQALPVSAILKSKSEVEDEPKKKSREDWRKAKELEEARKAGTAPAAVDEEGKDINPHIPQYISSAPWYYGTSGPTLKHQRPQDDKQKEYSDLNDWYKRGVDTSKIVTKYRKGACENCGALTHIKRDCMDRPRKVGAKFSGANIAPDEFIQKNLSLSFDGKRDRWSGYDPSEHKTVIEEFQKVEEAKRQLKSDKLNANEESEDEEKDEDKYVDEVDMPGTKVDSKQRITVRNLRIREDTAKYLRNLDPNSAYYDPKTRSMREDPNAGMDATYHGENFVRFSGDTTNHARAQLFAWEAHGKGVDVHLLAEPTKLELLKKEYEKKKDEVKSNIQGTVLEKYGGEEYLEAPPKSLLLAQTENYVEYSRSGKVIKGAEKEVIRSKYEEDVYINNHTSVWGSYWSGGHWGYRCCHSFIKNSYCLGESGKLVNAQPTAELITNDEPKEEQSQEDDKVEALEKESEESESSSSSDDEKSKAKSKKKLKKKMKKQKKKQKKKDKEVKMSSLMKDEDEEVVLDDRKRPYNSMFEAKKPTEEQMEEYFKKRRRDEDPMNQFM

SEQ ID NO: 11831 - protein, 206 aa, Phyllotreta atra
ISRDHWHKRRATGGKRKPLRKKRKFELGRPAANTKLGTRRIHYVRTRGGNLKYRALRLDTGNFSWGSEGTARQTRIIDVVYNASNNELVRTKTLVKNAIVVVDATPFRQWYESHYILPLGRKKGAKMTPEEEEIFNKKRSKKVQKKYETRQKTAKVEPAIEEQFHTGRLLACLASRPGQCGRADGYVLEGKELEFYMRKIKSKKAK

SEQ ID NO: 11832 - protein, 311 aa, Phyllotreta atra
MDRLLRLGGGMPGLTQAPPPSDAPVVDTAEQVYISSLALLKMLKHGRAGVPMEVMGLMLGEFVDDYTVRVIDVFAMPQTGTGVSVEAVDPVFQAKMLDMLRQTGRPEMVVGWYHSHPGFGCWLSGVDINTQQSFEALSERAVAVVVDPIQSVKGKVVIDAFRLINPNMMVLGQEPRQTTSNLGHLQKPSVQALIHGLNRHYYSISINYRKNELEQKMLLNLHKKSWMDGLTLADYSENCSVNEKTVADMLELAKNYNKALEEEEKMTPEQLAIKNVGKQATKRHLEEKVDILMTNNIVQCLGAMLDTVVFK

SEQ ID NO: 11833 - protein, 404 aa, Phyllotreta atra
MTVINKMEVDGPLKGEGFRSYYITKIEELQLIVAEKSQNLRRLQAQRNELNAKVRMLREELMLLQEQGSYVGEVVKPMDKKKVLVKVHPEGKFVVDIDKNIDINDVTPNCRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 11834 - protein, 199 aa, Phyllotreta atra
MVKLYCISILYKDTTYATWLKSAFDLQSFSFFQRGSVQEFMSFFCKTIVERTIPSSRQSVKEGEYMCHVYVRHDNLAGVVISDHEYPSRVSHTLITKILDEFAAKIPAVNWPTLQERDVAFPQLNTYLAKYQNPKEADAMTKIQEDLDETKIILHNTIQAVLERGEKLDDLVNKSEGLSIQSKAFYKTARKTNSCCSFT

SEQ ID NO: 11835 - protein, 242 aa, Phyllotreta atra; identical to SEQ ID NO: 11380

SEQ ID NO: 11836 - protein, 385 aa, Phyllotreta atra
MTEYWLISAPGDKTCQQTWDTMNNMTSKQNNLSANYKFSIPDLKVGTLDQLVGLSDDLGKLDGFVEQVTRKVAQYLGEVLEDQRDKLQENLQANNTDLPSYLTRFQWDIAKYPIKQSLRNIADIISKQVGQIDADLKTKSSAYNNLKGSLQNLEKKQTGSLLTRNLADLVKKEHFILDSEYLQTLLVIVPKAQFNEWNATYEKITDMIVPRSSELIIQDHDYGLFTVSLFKKVVEEFKLHAREKKFIVRDFTYNEEELAAGKNEITKLVTDKKKQYGPLVRWLKVNFSECFCAWIHVKALRVFVESVLRYGLPVNFQAILIHPNKKQAKRLRDVLNQLYGHLDSSAALSGPNVDSVDIPGLGFGQSEYYPYVYYKINVDMIESKV

SEQ ID NO: 11837 - protein, 557 aa, Phyllotreta atra
MSILASPLSVAGSRTTGASVRTQNVMAASTIANVVKSSLGPVGLDKMLVDDIGDVTVTNDGATILRLLEVEHPAARVLVELAQLQDEEVGDGTTSVVIIAAELLKNADELVKQKIHPTSIISGYRLACKEACRYIQDHLTIPVEELGKESIVNVAKTSMSSKIIGADADFFSQMVVDAATAVKVTDSKGNSMYPIKAVNVLKAHGKSARESFLVAGYALNCTVASQAMPKKIVNAKIACLDFSLQKAKMKMGVQVLITDPNQLEGVRARELDITKERIQKILATGVNVVLLSGGIDDVCLKYFVERGAMAVRRVKKADLKRIAKATGAAFVTSLSNMEGDETFDSNMVGEAAEVVQERISDDELIVIKGPKARTAASIILRGPNDFYCDEMERSVHDALSVVKRVLESKSVVAGGGSVEAALSIYLENFATTLSSREQLAIAEFARSLLVIPKTLAVNAAQDATDLVAKLRAYQNSSQTKKDHAHLKYVGLDLLEGTVRDNRKAGVLEPTMSKVKSLKFATEAAITILRIDDMIKLDAEQKGGKNYQDAMSSGELYD

SEQ ID NO: 11838 - protein, 273 aa, Phyllotreta atra
MFNSSQLNPPPFWSNGPAPGAFYNFPGTEWKPVSHPITHTQSPVTTSTSIVSITYDKGVLIAGDLLASYGSLARYKNCPRVIEINPNIILGAGGDYADFQYVKSFIEQKIIDEDCLDDGWKMKPKSLYCWLTRIRYQRRSKLDPFWNNLVVGGIQDGVPFLGTVDKLGTAYTDKVICTGYGAHIALPVLRDALDKKPNLHLNEAKALIKKCMEVLFYRDARSYPTYQLGIIDMDDGVKIEGPISVEENWNIAYMTYFLYFILEKMILFNKGWN

SEQ ID NO: 11839 - protein, 701 aa, Phyllotreta atra
MEFSKEPNFELLTAKDFSPEKYVKKLSQNYVGGSELQNLRRKIQGLSEETSSNLKKNVYENYIQFIETAKEISHLESEMYQLSHLLSEQKALLNCLSATSILEDVQPVNIERDNKVNEKDIEEENKQKIAAILEKVEGCQELLKVPGRIFLYEGDLLEIEPTENTALKIVHVYLFTDSFMITTRNSNSRGLMKYIYESIYDLSSLAVVNVRDLGNVKHAFKLLIFPDTRVFQCSSNSNKKEWLDKFDQAKKTRLAQEQQKRESISEKSPTRVSFESPSYNPFDEVEEETSALHPEWFVDIPEELDVCVAQRHFEDALSLLQKAKEYLNQATSASGDKRDTVFTDIQRKVEQRQNNLTEVLMKELEVNPDKSLQGGLRAARRAVRLLNQLGRETQSCTLFLKLCSSMLRTQCKRVKREGSTTTYIKHLSSVVFTNMCHMSDEFLRAFPDSPACASAYVVWASNELLQFTTHFIKQVFMPQTSLSTVTECIVLVRQQCERLYVYGLDLCYQLDGALRSSLMKALKDARDKLIDSIKLRVLDDKWIPINLHSKSALSRCVQEYSQMGLTNVGSYVSGDTWLQLTASTLSFTKMYLNLLNDCMKLKTTELMYTIDETLYNVFEAQVRHNENALRSELNQDQRNFLTKNAEFLLVSLMQVVQKQYEENVGYECPTLAKLQKEYIALQKGVTPASRSTKAKYSSEFI

SEQ ID NO: 11840 - protein, 1253 aa, Phyllotreta atra
MNELEKLEYLSLVSKICTELENHLGMNDKDLAEYIIHLSEKNNTLESFKKVLLENGAEFSDSFISNLLRIIQHMKPKKSSNKEDTDKVEKEGLAFKFPGLAIPNEKQKPLQLEEFGKENENDEIDVVADMMKQLEADAPSQKQTKEKSRSPSIERKSRIRSRSRSKERRRSRSRSKDRRRSRSRSRDRRRSRSKDRHSRRDKRHRSRSNEDYKRRRRDNSYSRDRRERGRSKESERRDRNRSRDDRKRDRSRSRTRRRERSYEKKFKSEKDNPEFEDDPTPGKIYNGKVSNVVPFGCFVQLEGLKRRWEGLVHISQLRAEGRVTNVTEVVSRGSKVKVKVLTITGQKVSLSMKDVCQTTGKDLNPLSHASTEREDKDRNPDRPTNNSTSVLRLPVSIDEGEEDSRKRVTRISSPERWEIKQMISSGCIDKSELPEFDDETGLLPKDEDGEADIEIELVEDEPPFLQGHGRALHDLSPVRIVKNPDGSLAQAAMMQSALAKERREQKMLQREQEVDSQPSGKNKNWIDPLPEEESKSMARGIGLQSQDLPEWKKHVIGNYFSITQLISKFVLNNILGGKKSSFGKKTNLTIIEQRQSLPIYKLKEELRKAVTDNQILIVIGETGSGKTTQITQYLAEAGFTARGKIGCTQPRRVAAMSVAKRVAEEFGCRLGQEVGYTIRFEDCTSPETMIKYMTDGMLLRECLMDLDLKQYSVIMLDEAHERTIHTDVLFGLLKQAVMKRDELKLIVTSATLDAVKFSQYFFKAPIFTIPGRTFPVEVLYTKEPETDYLDASLITVMQIHLREPPGDILLFLTGQEEIDTACEILYERMKSLGPDVPELIILPVYSALPSEMQTRIFEPAPPGSRKVVIATNIAETSLTIDGIYYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLCKMLIMSVALQCSDEILTIVSMLSVQNVFYRPKDKQALADQKKAKFNQPEGDHLTLLAVYNSWKNNKFSNAWCYENFVQIRTLKRAQDVRKQLLGIMDRHKLDVVSAERNTVRVQKAICSGFFRNAGKKDPQEGYRTLVDSQVVYIHPSSALFNRQPEWVIYHELVQTTKEYMREVTTIDPKWLVEFAPAFFKFSDPTKLSKFKKNQRLEPLYNKYEEPNAWRISRVRRRRN

SEQ ID NO: 11841 - protein, 417 aa, Phyllotreta atra
MNDGLQRKNKKNILAKVNFPLYTVQMVTSRHVIVGGGGGTSKTGVENGFEIYEIYHDGSKFSAKEVTRHETGGNVVMNCCVFSDRKHSFLVAGQENYSQLYRVNTKLIEHEQVETIGDSASVRHRNTKPKEHVDNNKNIKKELVFDMSPLDSIQTDFKGSEPLCRVVRINHSGKILATGGTDGDVRLWKFPTMQPLSILKGHTKEIDDIDFSKFDNLIITLAKDGLAILWDAQTGKLKSKLTWNTPEGSKYLYKRCRFGVIEDQKNKCMLYMIANATNSKQKSFLQQWIPEENTLKKFSEFNETLSALAVRDDGRFVAVGTMFSGSVSIHIAFSLQKILVVVGAHSMFVTGLEFLSHENTNHSISSVAEAAVLSISVDNQLCIHSVPYRRSIPLWIGIMVLILVLFITFMLCAYMGL

SEQ ID NO: 11842 - protein, 413 aa, Phyllotreta atra
MAGAMLFERAQSVPSQHDKLLKLNPADEDDEENIVNKEQDILNLGEKYKKEGKAKELAELIKATRPFLSLISKAKAAKLVRSLVDYFLDLEAGIGIEVQLCKECIEWAKEERRTFLRQSLEARLIALYFDTGMYTDALQLESTLLKELQKLDDKNLLVEVQLLESKTYHALSNLPKARAALTSARTTANAIYCPPKMQAALDLQSGVLHAADEKDFKTAYSYFYEAFEGFDSVESPKARTALKYMLLSKIMINSPEDVQQIVSGKLAIKYAGKDIEAMKAVAQAAHKRSLADFQLAVKQFKHELEDDVIVRAHLGTLYDNMLEQNLCRIMEPYSRVQVEYIAKTIKLPVLQVEKKLSQMILDAKFHGILDQGDGVLIVFEETPVDKTYEMALETIQSMSKVVVTLYQKAKKLS

SEQ ID NO: 11843 - protein, 607 aa, Phyllotreta atra
MKKTMRVLFVRFVSECLCCAKHRSKFLKKMASRSKKSSTPSAQQRPASPLSPTRHSRLQEKADLQNLNDRLAGYIDKVRFLEAENNKLSREIQTTQETVTREVSNIKSMYDHELSDARKLLDDTHREKARLEIDVKRLIEENEELKAELAKKSKDLVIAENHARIYETRCNEYQLKANQAAADAKKAIADAKELEKERDKLKKLLDAARKQLEEESLARVEVENHNQSLREEIVFKDQIHQQELTETRTRRQVEISEIDGRLAQKYEAKLQEALQDLRDQYESQMANNRQEIELLYEQKIKNLQAAADRHQSTASGALDELRQVRTRIDTFSSRIQDLENQNQGLAARTRDLEKLLENERIRHAEDLALVERELHRMREEMATQLQEYQDLMDIKVSLDLEIAAYRKLLEAEEARLNITPTGGDHEVHQRSSSQRRTPVRLGAKRKRALLEETQESSMSDYSVNSSSKGDIEVAAVDPDGQFVRLHNKSNQEVPLSGWQVIRRAGDEETFYKFHRTVKVEGNGTVTIWSSDLNKDHEPPSNLVMKGQKWVTGDNMFTIVLNSNGEEVASSERVKRQISTSHLRHRELGDEELFHQQGDLQGEKCGLM

SEQ ID NO: 11844 - protein, 795 aa, Phyllotreta atra
MADSKSPDDLATAILRKKDRPNRLLVEEAVNDDNSVVALSQAKMDELQLFRGDTVLLKGKRRKETVCIVLSDDSCSDEKIRMNRNVRNNLRVRLSDVVSIQPCPDVKYGKRNDNSVVALSQAKMDELQLFRGDTVLLKGKRRKETVCIVLSDDSCSDEKIRMNRNVRNNLRVRLSDVVSIQPCPDVKYGKRIHVLPIDDTVEGLTGNLFEVYLKPYFLEAYRPIHKDDVFIVRGGMRAVEFKVVETDPAPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSEAALQQIREKMDLIDLEDDQIDAEVLNSLAVTMENFRYAMTKSSPSALRETVVEVPNVTWDDIGGLANVKKELQELVQYPVEHPDKFLKFGMQPSRGVLFYGPPGCGKTLLAKAIANECQANFISVKGPELLTMWFGESEANVRDIFDKARSAAPCVLFFDELDSIAKSRGGNVGDAGGAADRVINQILTEMDGMGAKKNVFIIGATNRPDIIDPAILRPGRLDQLIYIPLPDEKSREAIFKANLRKSPVAKDVDLIYIAKVTHGFSGADLTEICQRACKLAIRQSIETEIRRERERALNP

SEQ ID NO: 11845 - protein, 274 aa, Phyllotreta atra
MSDQFDCALDLMRRLPPQQIEKNLSDLIDLVPSLCEDLLSSVDQPLKIAKDKDSGKDFLLCDYNRDGDSYRSPWSNTYYPPLEDGSMPSERLRKLELDANLAFDQYREMYFEGGVSSVYFWDLDHGFAGVILIKKTGDGSRKIKGCWDSLHVVEVQEKSSGRNSHYKMTSTAMLWLQTNKQGSGTMNLGGSLTRQIENDAAVNDINPHIANIGRMVEDMENKIRNTLNEIYFSKTKDIVNSLRSVQPLTESRQQQALKQDLAAALQRRQNKSEN

SEQ ID NO: 11846 - protein, 1097 aa, Phyllotreta atra
MERPPRNEPPVEPVNGVVQPPVHPPPDSPGRVTNQLQFLQKTVLKAVWKDKFAWPFQQPVDAKKLNLPDYHRIIKQPMDLGTIKKRLENNYYWSGKECIQDFNTMFTNCYVYNQPGEDVVVMAQTLEKVFLTKVADMPKQEFVVDMPMKGAKGKKGRVSVGGVGGGGGGGSTPSSSGPVPAAIVPGGVRGRPPATVSSTSTTPIATTTGSSGLPLGTQAPATLPGSTATTTIAPANNNNSSLTPQQLGTPVSSMHGTPGAPLSNSLDPTGGVLPSNVMPPAQPAKVKKGVKRKADTTTPATAYDYPTVLESKSAKISTRRESGRQIKKPARREIDLHVPQPAIHKPNDKLSESLKACNEILMELFSKKHSNYAWPFYQPVDAELLGLHDYHDIIKRPMDFGTVKEKMDNREYRTPQDFAADVRLIFSNCYKYNPSDHDVVAMARKLQDVFEVKFAKIPDEPLNRIGGAVNNLPIKSESSSSGSSSDSSSESEDSEEERRNKQLKVLEKELTALQEKMRKLVEESSRRKKEKKKNKMKKKPSGGGGMSAAGAGALPNSSSGLGLRGNKPAAAANAAPKRVKANNKTGAGRKKNAAQPPPMPFDSEDEDNAKPMSYDEKRQLSLDINKLPGDKLGRVVHIIQSREPSLRDSNPDEIEIDFETLKPSTLRELESYVASCLRKKPHKKVAGKSKDEQMAEKKQELEKRLIDVNDKIGNSKKAPKKDEANKVDPTGAGGPSGRLSSSSSSSDSDSSSSSLSSSSSDSSDSEAGGTTNRSTKKKVNKKSPNPSVDNTTITKPQQPTTAPPMPQTPANASVTAAAPANTNAPPPQVPATVNNNFPPPQQQQQAVAPGKQQQHNVVNVPPAQLVPPLNIKPIGIEKLSAVNPVTPASVPQAPKSVALPTPSPDKPKPNVIAHMDTYTDPIEQSLANLEQDTVTVQQLTNPIPTHPVHMNLNPNVTHPVLQPSSLNMDMKAPVTMATSMLHHMPMSMDAGDLPALMQTQANLMHAQNNGFGIKHEFDLTANNNGITSMGLPMEMSISSMFDQLPQHISGQMIKPDPGQDRLDGLVGALISEKKPPPGVPPAASKPQTFGFKQEKAE

SEQ ID NO: 11847 - protein, 406 aa, Phyllotreta atra
MSLSTARPLVSVYNEKSEEVKGNGVALPAVFKAPIRPDVVNFVHQQVSMNHRQPYSVSDKAGHQTSAESWGTGRAVARIPRVRGGGTHRSGQGAFGNMCRGGRMFAPTKPWRRWHRRVNINQRRYALASAVAASGVPALVMSKGHVVDQIPELPLVVSDKVQEMHKTKEAVQFLRRIKAWADIQKVYKSQRFRAGKGKMRNRRRIQRKGPLIVYYKDQGLRQAFRNIPGIDLISVQKLNLLKLAPGGHVGRFVIWTESAFQRLDKLFGTWKNPSTEKKGYNLPQPKMSNTDLSRLLKADEIKAVLRTPQKKVVRRVRRLNPLTNTKAMLKLNPYAAVLKREAILKNQKRQLQRDEALAKKRGITLTPDNAVIRTRKLQERRRAQILKDKKSKPKKAAKAPAKKPAG

SEQ ID NO: 11848 - protein, 1757 aa, Phyllotreta atra
MADFLNSEAEESSEEEELDHRDRKKAQKAKLVDSSDEEEEEDDEEKIREELKDLIDDNPIEESDAESDASGREKRKKSDDEDLDDRLEDEDYDLLEENLGHKVERRKFKRLRRFEDEESEGEEEHDPDQDREQIAMDIFSDDDEERRSERSQRPVVEQESFGVGEEEEEGDYSDADDFIVDDDGRPLIEKKRKKKPIFTDAALQEAQETFGVDFDYDEFTKYDQDEYEDEEDEEEDEYEEDDNERRKHPKKAARKKLTKKSIFEVYEPSELKRGFFTDLDNEVRNTDIPERMQLRDVPITPVTDDSTELEDEAEWIYRQAFCNKAVSNVDAHLSAEAREKMKKGSQTVGKIKKALDFMRNQQLEVPFIAFYRKEYVQPELNINDLWKVYKYDAKWCQLKSRKENLLKLFDKMRHYQLDQLVKNPDAPIPDNVRVMKDSDIERLKNVQTAEELNDVHNHFILYYSGDLPAMHAAWRIKEKEQRKFEKRQKRLKQIAEAEEGADIPDEPEDDDDDEPEIETLKYANRSGSYALCSKAGLDPLAKKFGLSPEQFAENLRDNYQRHEVDQEPVEPSDVAKDFISPKFSTADEVLQAAKYMVALQIAREPLVRKCVREVYFERARLNVYPTKKGQKVIDESHNCYSMKYLKNKPVRDLNGDQFLKLCLAEEENLLTITINDNIEGNTSNSYIEEVKQLYIKDEFSKNVQDWNALRMECVERALTKSVLPDLRTELKRTLLSEAKEFVLKACCRKLYNSIKVAPYSITFPDEDEDEWDTSKGVRVMGLAYVPEYTVSAFACIAAPDGDITDYLRLPHILKRKNSFRTEEKLMKETDLQALKNFIFLKKPHVIAIGGESREALMIADDLKALINELVESDQFPEIKVEIIDNELAKLYANSNKGQADFRDYPELLRQAISLARKMQDPLIEYSQLCNGDEEILSLRFHPLQEQIGKEELIEALCLEFVNRTNEVGVDINLAVQQAHKSSLVQFVCGLGPRKGQALLKVLKQTNQRLENRTQLVTACHMGPKVFINCSGFIKIDTNSLGDSTEAYVEILDGSRVHPETYEWARKMAVDALEYDDDEGANPAGALEEILETPERLKDLDLDAFAEELERQGFGNKSITLYDIRAELNCRYKDLRQPFHSANPEELFDMLTKETPETFYIGKLVTASVIGIARKKPKPDQLDQANPVRNDETGLWQCPFCLKNDFPELSDVWNHFDAGACPGQATGVKLRLDNGIMGYIYIKNISDKPVSNPEERVGVGQLISCRIIKIDVERFSVDCTSKSSDLLDKNHEWRPPRDPHYDTEREEKDNRTEAEKKKEKQRLTYIKRVIVHPAFHNISYAEAEKCMVNMDQGEVIIRPSSKGADHLTITWKVADNIYQHIDIREEGKTNAFSLGKSLLIGNEEFEDLDEIIARHVTPMAAHARDLLYFRYFKEFEGGHKDKAEEFLKDEKKKNASKIHYVVSAAKHLPGKFLLSYLPRNKVRHEYVTVTPEGFRFRQQMFDSITSLFKWFKEHFREPPPGGMTPGTPRMSTGRTPYDMSTEAIQRVAQNLPSDMVQALSAATNQTPHYPHTPGGYGGNYINTPYTPSGQTPYMTPFQTPHAQQTPRYGQQTPSQPSLSNPFLHPGAVTPSQRTPSYRNLSSQSPMIPQSPVPSPGSQSSYSSHMSHHTRASYGDSMRFQPPESPRNYPSSRGSYPDGRYGGSESMDWQKAAEAWASRSRCKCFVEVYRYRMIVFLLFSNATKRRSGDSQVVWSQNSS

SEQ ID NO: 11849 - protein, 749 aa, Phyllotreta atra
MLTSRTGGAYIPPAKLRLMQESITDKSSAAYQRIAWEALKKSVHGYINKINTSNIGIIAREILHENIVRGRGLLCKSIIQAQAASPTFTNVYAALVAVINSKFPNIGELLLKRLVLQFKRGYKQNNKSICISATTFVAHLVNQRVAHEILALEILTLLVETPTDDSVEVAISFLKECGQKLTEVSSKGITAIFEMLRNILHEGQLEKRIQYMIEVMFQIRKDGFKDHAAVTEELDLVEEEDQFTHLIMLDDVKEVNAEDILNVFKFDEHYEENEGKYKTLSKEILGSDSESESGSEGSEEESEGEGEDEEVKDAGKIIDNTETNLIALRRTIYLTIQSSLDFEECAHKLLKMELKPGQEIELCHMFLDCCAEQRTYEKFYGLLAQRFCQINKIYIEPFQQIFKDTFATTHRLDTNRLRNVSKFFAHLLFTDAIGWEVFEIMKLNEEDTNSSSRIFIKILFQELAEYMGLGKLNARLKDETLQQHFAGLFPRDNPKNTRFSINFFTSIGLGGLTDELREHLKNVPKIMEIKTTAVKEESESSSSSSSSSSSSSSEEDSSDYSSGSSSSSSSEEDSSDYSSGDSSSEDEKQREKSKKKKKKRDSESKSSKSDSKSNPKDEKRDRGKHKKNKDKEDRKETHKNKENRSDSDKHVSREKQNSRQDKRKDDGDVKEKPRKDDRDDRERQRRNEEKGGRKKDYEWVKSRHEDNIHQLKTSKKVFEKPSKHRSRSREKISSKEKDRKHRSKERRKS

SEQ ID NO: 11850 - protein, 606 aa, Phyllotreta atra
MHFTASRYHSHCQLKNQVGQKIMNEVIKHKASKKNGPAVTQPHNASGVDWRILVVDQLAMRMVSACCKMHDISAEGITLVEDIMKKREPLATMEAVYLITPSEKSVHALMNDFESPRPMYRGAHVFFTEACPDELFNKLSKSHAAKYIRTLKEINIAFIPSESQVFSLDSPDTFQCSYDPSFAAARNANMERMAEQIATLCATLGEYPHVRYRSDWERNVELAQLIQQKLDAYKADEPTMGEGPEKARSQLLILDRGFDCVSPLLHELTFQAMAYDLLPIENDVYKYEASAGVQKEVLLDENDELWVELRHQHIAVVSQSVTKNLKKFTDSKRMTQSDKQSMKDLSTMIKKMPQYQKELSKYATHLHLAEDCMKAYQGYIDKLCKVEQDLAMGTDAEGEKIKDHMRNIVPILLDTKITNEYDKMRIIALYAMTKNGITEENLTKLATHAQIKDKQTIANLQLLGVNVINDGGPRKKIYTVPRKERITEQTYQMSRWTPVIKDIMEDCIEDKLDQKHFPYLSGRAQTTGYHAAPSSARYGQWHKDRGQQAVKNVPRLLVFVVGGISFSEIRCAYEVTNAQKNWEVIIGSSHILTPEGFLSDLATLAG

SEQ ID NO: 11851 - protein, 712 aa, Phyllotreta atra
MMQQYMKELEQEPFDAEEFVERLAWRTLAESKSEGEENEINPALLHESFVQAIKDLNLLHERQQKKCEKLEVAVREDEATFFQEVYNLLEQNKQAMDTFQELDGKINHVATKVLHLGDQLDSVNGPRSRVVDALSLMTHLREFLSNEPVSSTIFTNEEYIDEAADVIQKLYLISQDLPPKFESIKRKIERKYSDIEKTLIEEFVGAMDNENLTRMKEIALVLSQFKGYSQCIDSYIDHSQVGCLSSKDVFYNFLNLCKYNDEIIRKVFKNPEQVMAKFVLNIYQLKLVEYIDQKLNSKLGTYSYLQTLYELYSKTNHLSSELTVFHMGNDKNYLSKLTTNIFNKYINDYISMELKCLKDRCSTNLQKYYDSKNHQKKQIQSGGFQDLRRDLQAVIGTRANINIAQIENYGGETFLSEELAIMILQDTKQAFQRCLLLSKGSERASNATQILDRLINSLLIEHVDYAVELGLHAVPVVEGVRNPPVLYFFNIVHQSNNITHLVEKQFMDLVVPLVENTSKYSDCVQKKKFVLEDIERKINTGLDRCLSAILNWVKLYLQSEQKKSDFKPESDDFDTVASPACKNVLNYVNSIVKEIKTNLDGNNVTAILQELGIRLHRVVYEHLLQYQYNTAGAMVAICDLNEYRSCTKQLGPLVAELFDTLHALCNLLLVKPENLQQVCSEDSLVKLDRAILHSFIQLRSDFKVQKQTILKV

SEQ ID NO: 11852 - protein, 270 aa, Phyllotreta atra
MDFQNRPGGKTGGGGVASWSETNRDRRERLRQLALETIDLQKDPYFMKNHLGSYECKLCLTLHNNEGSYLAHTQGKKHQANLARRAAKEAKDAPTLLQPEKPRVEPKKFVKIGRPGYRVTKQRDPETGQQSLLFQIDYPEISDLVLPRHRFMSAYEQKIEPPDRKWQYLLFAAEPYETIGFKVPSREVEKTDTKFWTHWNRDTKQFFLQFAFKNENKRNVNSVVQRHSIVGGVPPPPMLPVPPPPRPPMFNPIPPPPPMMRAVLPVPPPN

SEQ ID NO: 11853 - protein, 133 aa, Phyllotreta atra; identical to SEQ ID NO: 11398

SEQ ID NO: 11854 - protein, 442 aa, Phyllotreta atra
MATNLSRTSLLRIINARGYAACPHPLSGVPNAEVKSTVLPNKTVVAAVDNNAALTRVSIVFRAGSRNEDPDNLGVAHVLRSAAGLSTKNCSQFAIIRNIQQLGANLTATSDRETICYTLEGTPEAVECAIPFLTEVATQQEFRPWEISELSGRLQLDIATRPLQLRAIDLLHNAAFRGRGLGNSLFIPKTQIGKISSETLQHYVASNFVSGRMAVVGSGICQKELTSFANSLKIENGEGNNAPSPYVGGELRSNKGGQLAFIAVAGEGAAITNTKEALAFAVLQGALGGGPQVTHGVCDNGVFRKALGSNPNVSSVAINASYSDTGLFGLLLAVPTKSAGGALEAAVKVLKSGSVSDEDVRRGKNQLKTSILFGAESGADIVRRIGQEAVLTQKATSVDALVADVDSVSTSDVANALKKAGKKLSLASVGNLAGVPFLDELK

SEQ ID NO: 11855 - protein, 110 aa, Phyllotreta atra; identical to SEQ ID NO: 11628

SEQ ID NO: 11856 - protein, 496 aa, Phyllotreta atra
MSYPSTLNSKQAAQEHGLAVSRDFVSQPMLTYKTVSGVNGPLVILEDVKFPKFNEIVQLKLADGSLRSGQVLEVSGSKAVVQVFEGTSGIDAKNTVCEFTGDILRTPVSEDMLGRVFNGSGKPIDKGPPILAEDFLDIQGQPINPWSRIYPEEMIQTGISAIDVMNSIARGQKIPIFSAAGLPHNEIAAQICRQAGLVKVPGKSALDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHSDVSNQLYACYAIGKDVQAMKAVVGEEALTPDDLLYLEFLTKFEKNFISQGSYENRTVFESLDIGWQLLRIFPKEMLKRIPAATLAEFYPRDSRH

SEQ ID NO: 11857 - protein, 163 aa, Phyllotreta atra
MNEIRERERAGIRVPDELRAMLLEFTCSYLLEQPEDVVSYAQEYFTKFKESRGTALIYDQDMYEEETMGIKTVLARQIFDSRGNPTVEVDITTELGLFRAAVPSGASTGIYEALELRDNIKTEYHGKGVSQAIKNINTIIAPELIKAGFEVTQQREIDEFMIN

SEQ ID NO: 11858 - protein, 780 aa, Phyllotreta atra
MSYMQTNQNRPMSQGYHQGANDLPMQSSKEQTLLWQQNSYMGDSGIQSGAATQVPSLSGKEEEEMDLFDLDQPYQGFTQEQVDEMNNQLNHTRSQRVRAAMFPETLDEGIEIPSTQFDPNHQTAVQRLAEPSQMLKHAVVNLINYQDDADLATRAIPELIKLLNDEDQVVVSQAAMMVHQLSKKEASRHAIMNSPQMVAALVRAISNSNDLETTKGAVGTLHKLSHHRQGLLAIFKSGGIPALVKLLSSPVESVLFYAITTLHNLLLHQDGSKMAVRLAGGLQKMVALLQRNHVKFLAILTDCLQILAYGNQESKLIILASQGPIELVRIMRSYDYEKLLWTTSRVLKVLSVCSSNKPAIVEAGGMQALAMHLGNPSTRLVQNCLWTLRNLSDAATKVDGLESLLQSLVQVLQSSDVNVVTCAAGILSNLTCNNQRNKVTVCQVGGVDALVRTIVSAGDREEITEPAVCALRHLTSRHVESEMAQNAVRLNYGIQVIVKLLNPPSRWPLVKAVIGLIRNLALCPANHAPLREHGAIHHLVQLLMRAFQDTQRQRSSVASGGSQPPGTYADGVRMEEIVEGTVGALHILARESHNRAIIRQQMVIPIFVQLLFNDIENIQRVAAGVLCELAADKEGAEMIENEGATAPLTELLHSRNEGVATYAAAVLFRMSEDKPQDYKKRLSMELTNSLFREENLWNPDLGMGPDLQVCYKFVLFEYRYSKCEWGMYYQSIEFGMNALATVFSILFMIILKYIYSTVYFFIFVLFCFLHFFLFAIFRIF

SEQ ID NO: 11859 - protein, 266 aa, Phyllotreta atra
MARNAEKAMTTLARWRAAQLGEIDKHKKRRPYLASECKSLYACEKWRMQIIREIAKKVAQIQNAGLGEFRIRDLNDEINKLLREKRHWEDQIKELGGPDYQRVGPRMLDHEGKEVPGNRGYKYFGAAKELPGVRELFEQEPPPPPRKSRAELMKDIDADYYGYMDDDDGILIPLEIKAEKTAVQNAIAEWVNNKEKNLDSTKGIEESIYVVEDSDEEDVVQQFDGSQQRFVAHVPVPSQQDIEQALLRRRKQELMEKYGVQDEQDV

SEQ ID NO: 11860 - protein, 214 aa, Phyllotreta atra
MTQQDIPTFKCVLVGDGGTGKTTFVKRHLTGEFEKKYVATLGVEVHPLVFHTNRGPIRFNVWDTAGQEKFGGLRDGYYIQGQCAIVMFDVTSRVTYKNVPNWHRDLVRVCENIPIVLCGNKVDIKDRKVKAKSIVFHRKKNLQYYDISAKSNYNFEKPFLWLARKLIGDANLEFVAMPALVPPEVVMDPQWQTQIEKDLREAQETALPDDDEDL

SEQ ID NO: 11861 - protein, 52 aa, Phyllotreta atra
MIYTTVSLISLCFASGDHKTSFTDILMNIVGVFMWVAVGATALHYWLGYLSE

SEQ ID NO: 11862 - protein, 838 aa, Phyllotreta atra
SIFKMPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEEGEDAVDDPRKLKPGEIDPNPETKPARPDPKDMDEDELEMLSEARARLANTQGKKAKRKAREKQLEEARRLAALQKRRELRAAGIEVTSRRKKKRGVDYNAEIPFEKQPAIGFYDTSNEALDLMAPDFSKMRQQHLDGELRSEREERERKKDKQKLKQRKENDIPQAMLQNEEPAKKRSKLVLPEPQISDQEMHQVVKLGKASETAREIATESGVETTDTLLNDYMFTPQAAATPRTPAPQTDRILQEAQNMMALTHVDTPLKGGLNTPLHNSDFSGVLPQSQAITTPNTVLATPFRSTRSDGGATPGSTAGFMTPKSGALTPVGKNATPSIRDKLNINAEESLDVGSTPAEHRMFQMSMKDQLKLGLSSLPQPRNDYEIVVPENEAQDEPEEAQAQLVEDQADVDARKQEELRAKAAQELASRSQVIQRELPRPQEVNLTVLRPPNESYSLTDLQRAEELIKCEMVTMLQFDNLKNPLPAQSKRSNMSQAQQLAFLEQHPYDSFKKEDLEVAKTLLRSEMDVVKSGMNHGELPLEVYNQVWEECLSQVLYLPNQTRYTRAHLASKKDRLESAEKRLEQNRSHMAKEAKRAAKMEKKLKILTGGYQSRAQVLIKQLQDQYESIDQSTLELNTFKFLAEQEKNALPMRIQSLTEDVNRQMEREKVLQMKYADYQGQIKELQEEYLVQMQTVPNEETSKYDEVTSTTNEENGMDTSENDKITAEN

SEQ ID NO: 11863 - protein, 157 aa, Phyllotreta atra; identical to SEQ ID NO: 11072

SEQ ID NO: 11864 - protein, 416 aa, Phyllotreta atra
MYGLQRYSFCYTLKNAVRYYSREPAKRSSFLSRLYDNFKDEMNKNKEMKESLKKFREEAQKLEQSDALKAARQKFETVEKEASKSGEVFKESLGSIKERVKGVIDEASKSDLAKKAGKFTEEVGKTTHKISETAQEISKTGAFQSISEATKAVKQEIDNTSMEGRVYVSPKKLRKRTETSAVVQQKYYEPNTDATGVELHKDSKFYESWQNFKNNNPYVHKVMDWKLKFDESENPIIRASRALTEKVGDIMGGLFQKTELSETLTEICKIDPDFDTKRFLKQCETDIIPNILEAMTRGDLDVLKDWCHEGPFNLFAVPIKEAYKKGYKIESKILDVDHVDLVMGKVMDQGPVLIISFTSQQVMAVRDPSGAVVEGDPDRVMRVNYVWVLCRDVVEPDPRAAWRLLDLSASSNEQLV

SEQ ID NO: 11865 - protein, 302 aa, Phyllotreta atra
MSSSDSELNDSDAELQQALLDGKLKPGLNKIEQAPKQFVNNVSGLNQKIEEFKLNLPWIERLDCTNAQAPLAPELAEEMLAHEEKRSNQLRNNKKLPQFQPSEDPVLNDFKRELIFHRQAQATILDAIPKIKELGISTKRPDDYFAEMAKSDEQMHKIRENLKQKQEQQKRSERVKQLRQQRKEGKSLQVQLKLQRSKEKKEMMDQVKKAKKNFDFLDEKNKPMGKNKVAERRKMKDKKFGFGGKKKGMKKNTKDSAGDISEYRNPGKAKKQMGNKFVNKNKPKNQRMGKNRRIKTKAKGKK

SEQ ID NO: 11866 - protein, 1253 aa, Phyllotreta atra; identical to SEQ ID NO: 11840

SEQ ID NO: 11867 - protein, 623 aa, Phyllotreta atra
MNPSAPNYPMASLYVGDLHSDITEAMLFEKFSSAGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDESGVSKGYGFVHFETEEAANKSIEKVNGMLLNGKKVYVGRFIPRKEREKELGEKAKLFTNVYVKNFGEDLSEEQLRTMFEKYGKITSYKIMSKDDGKSKGFGFVAFESPEAAESAVEALNGKEILEGKPLYVGRAQKKAERQQELKRRFEALKMERLNRYQGVNLYVKNLDDTIDDERLRKEFSPFGTITSAKVMMEEGRSKGFGFVCFSSPEEATKAVTEMNGRIVGTKPLYVALAQRKEDRKAHLTSQYMQRMANMRMHQMGQFIQPGGSSGYFVPTIQATAPRFYGPAQMPIRTSPRWPAQTPVRPGAQGSTATYTGMPNSYRAAARPPGQSTMRSNISVPRPITGQQPPSMHGRPLVGQGVAAAGNRAANFKYTANMRNPPQALLPGAQAQVQQAVHIQGQEPLTATMLAAAPPQEQKQMLGERLFPLIQRMYSDLAGKITGMLLEIDNTELLHMLEHQESLKNKVEEAVAVLQAHQAKQAAIKKD

SEQ ID NO: 11868 - protein, 866 aa, Phyllotreta atra
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSGLVEDQGFLEQLKELLSDSNPMVVANAVAALSEINESSPTGQPLVELSTNTINKLLTALNECTEWGQVFILDSLSNYTPRDEREAQSICERITPRLAHANAAVVLSAVKVLIKMMEILAGDTEFCNTLSKKLAPPLVTLLSSEPEVQYVALRNINLIVQKKPDILKHEMKVFFVKYNDPIYVKLEKLDIMIRLASQVNIAQVLSELKEYATEVDVDFVRKAVRAIGRCAIKVEPSAERCVATLLDLIQTKVNYVVQEAIVVIKDIFRKYPNKYESIISTLCENLDTLDEPEARASMVWIIGEYAERIDNADELLDSFLEGFGDENAQVQLQLLTAVVKLFLKRPQHTQGLVQHVLSLATQDSDNPDLRDRGFIYWRLLSTDPAAAKEVVLADKPLISEETDLLEPTLLDELICHISSLASVYHKPPTAFVEGRSAGIRKTLPARQGSDDTAAAPETTVIPNQESLIGDLLSMDINAPAPSAAAAPAAPQTSNVDLLGGGLDVLLGGGNDIAAAPASAAAPTTTGLLGDIFGIPTAPTMYTPPKVIWLPAEKGKGMEIYGTFSRRSGQMAMEMTITNKAMQAMSGFAIQFNKNSFGITPSAPMNVPTLQPGQNLEYSLPLNTTGPVQRMDPLMTLQIAIKNNVDVFYYACQIPIQILFGEDGTLDKRVFLTTWRDIPGANEVSMLVNLNVVWYSVYNFRGIKKMFDFYAKITTG

SEQ ID NO: 11869 - protein, 165 aa, Phyllotreta atra
MGPKFDPNEIKVVYLRCVGGEVGATSSLAPKIGPLGLSPKKVGDDIAKATSDWKGLKITVQLTIQNRVATISVVPSAASLVIKALKEPPRDRKKVKNIKHSGNITFDDVLNIARTMRSRSMAKEFKGTVKEILGTCQSVGCVIDGKQPHDYIDMIDDEELEIPDE

SEQ ID NO: 11870 - protein, 364 aa, Phyllotreta atra; identical to SEQ ID NO: 11639

SEQ ID NO: 11871 - protein, 288 aa, Phyllotreta atra
MASEGEEVISDQEKVKIVSDFILHSPPGEFNEVFNDVRKLLNNDDLLKEGVTGAFAQYNKDQLTPVRIENADQMVLITEYNDLGNNRFFDPRSKQSFKYEHLRKEASDYQPYSVDTAAEPWRAALDNEFIQYTRNHYKDGVCSVFGRSQNGAIALTACIEDHQFQPKNFWNGRWRSQWSVSLTDEATAEVRGVLKVQVHYYEEGNVQLVSTKEIKESIPVSNEAQTAKEIIHVIEQAENLYQTAISENYQTMSDTTFKALRRLLPVTRTKMDWNKIVSYSIGKELKTQ

SEQ ID NO: 11872 - protein, 1074 aa, Phyllotreta atra
MERDLRDRQDRMGVEIRERLKWDIREGVIGSETFNPKHAIIVTWKNVSFNGGYANAVYQTNTFQMVLATDEVFTYAMFNYLNLDWTSHTEAGGDTRKGEGGTPAFVGFNAGNGTRSFQYAPYSQASVIRDLTATGWGNNKPGRHIFRIDENILLGSCNKDIDGANLPLQFAPESGNMLGGTVVNITGPCFQPNDRIRCKFDVYDEVVGYVVDRNRAICIQPRLYSEGWVRLQIAINSDAFKWNVNITGPCFQPNDRIRCKFDVYDEVVGYVVDRNRAICIQPRLYSEGWVRLQIAINSDAFKWKGKYYVESPASASQKIFFKDMKYHEKSPSEIRITWQKQNLTTNENANIRISLWGYRETTMRPTFVYITEIADNVQNTGEYTIVPSQYRGKINQFLTDIKFGFLQINLTESIKVNIYSTNNQNIDITPIIWSRPIPLGWYFQFQWENQYGKNWPKHLCDDWLRTDRYLKNFAHELPQCPCTVQQALADKGKFMPDFDCDKDSNPVCYYNNQALHCVKTGAPTMEGSEQQCCYDKNGYLMLSYDQQWGSSPRRCHNLGKMPYNEATKVPTLSQWFNDIVPKYLCCLWQEEQAVGCETLRFERRPSQDCVAYQAPAVAGVYGDPHIVTFDDVEYTFNGKGEYSLVKSVKVDDNLEIQARFEQMDMNAYGEVRATQLTAIVAKGNKTIPIEVRRRPLEARWRYRLDVIAENRRLFFDRPSLKFQHFQGVTVYTPTYILNQSEVLIMFDNGAGVEVLDNQGYMSARVYLPWSFINKTVGLFGNWSFNKEDDFTLPDGSKAAVVSNINDMERVFNDFGSKWMLDDVSDARKGQSLFYREFGRTSATYNNKTFKPQFLMLPEDILPPNRSEQIQRTYDVCSTKMYECYYDYAMTLNRDLAHFTQNYKATIYELKQTTREKIMSCGVLETPRFGRKSTFLFVPGTKVTYECIQDFVLVGDPRRECGGDGKWNIPDYGYTYCLRQQEYSQRQAGITSGIIMLVLIPLILLFVYLAYRFLKKKQKEREENRLEQEQYREQSRKAQEAATMKLTEHEEEFNSEEEDDHSNVTSTGAKETNIY

SEQ ID NO: 11873 - protein, 106 aa, Phyllotreta atra
MRYVAAYLLAVLGGNASPSSADVEKILGSVGVEAEAEKVKKVLGELKGKSIEELITKGRDKLSSMPVGGAAPVAVAAVAAAPAAAEQKKGIFLFYSITYNNHSKKS

SEQ ID NO: 11874 - protein, 906 aa, Phyllotreta atra
MTDRFGLKWDPKNLEIRTMSVEKTLEPLVLQVTTLVNTKGPSKKKKGKSKRANALVSTVEKATENFIEKGEQIAYENPDITDEMIAAVEEVRKTGNAMSIAAREFSEDPCSSLKRGNMVRAARNLLSAVTRLLILADMVDVHLLLQSLHVVEDDLEKLKNASSQGELLDNIKAFGQNANELMNQAAKRQQELKDPQLRDDLAAARAVLKKHSTMLLTASKVYVRHPELAAAKANRDYVLKQVCEAVNTINDVAQGRTPQPASGPYDGPGELAAALDDFDDHMVMEPLAYNEVHTRPSLEERLESIISGAALMADSSCTRDERRERIVAECNAVRQALQDLLSEYMTNMGKKDKSENLNRAIDNMGRKTRDLRRQLRKAVVDHVSDSFLETNVPLLVLIKAAQNGNEKEVEEYAVVFTEHSNKLVEVANLVCSMSNNEDGVKMVRYAAAQIDNLCPEVINAARILAARSRSKVAQENMEAFKQSWENQVRILTEAVDDITTIDDFLAVSENHILEDVNKCVLALQEGDADTLDRTASGIKGRSNRVCNVVTAEMDNYEPCIYTKRVLEAVKVLNDQVMPKFTQRVQVAVQALGNSPPKEVDENDFIDASRLVYDGVREIRRAVLMNRADEDLDPEDVELDENYLIETRSKSSAHTGEHGVDEYPDISGITTAREAMGKMPEEDKQKILQQVEFFKSEKLKFDREVAKWDDTGNDIIVLAKHMCMIMMEMTDFTRGKGPLKTTMDVINAAKKISEAGTKLDKLTRQIAEQCPESSTKKDLLAYLQRIALYCHQMNITSKVKADVQNISGELIVSGLDSATSLIQAAKNLMNAVVLTVKASYVASTKYPRQGTIASPIVVWKMKAPEKKPLVRPEKPEEVRAKVRKGSQKKVQNPIHALSEFQSPTESV

SEQ ID NO: 11875 - protein, 409 aa, Phyllotreta atra
MSFNFGNTGTPKTAATGFTLPSNPATSTTSATGLQFNFGGGDTKTEVKPSSTLFPTATSTPPAFGITPKPATPASAAAPSFNFGTPTTQQTTASAFGTATPASFSTPTSALQFGLTTTKPETSTGLFGSTAAATPISASTGLSFGTAVSTTSSATAAATGTPLFGVAPTSSTTTIASVPALGLSTTVSVAASTTPSTSLSTTTAPPAYSTSTLPSSGSLTFSQLEDSINKWTIDLEEQGKFFINQAKQLNAWDSLLISNGEKILNLNGSIERVKQQQQQLDQELDFVLAQQKELEELITPLEKELLEIPVTDIDRNQMYQFSEIIDSQLKQMSDDLKEIIEHINESNKSEEISNPLTQISRIMNAHMNSLQWLDRNTAQIVSHLEQISKMQDSNRRNFPLNHSFNNSLL

SEQ ID NO: 11876 - protein, 193 aa, Phyllotreta atra
MFIWDWFTGVLGYLGLWKKSGKLLFLGLDNAGKTTLLHMLKDDRLAQHLPTLHPTSEELSIGNMRFTTFDLGGHSQARRVWKDYFPAVDAIVFLVDANDRSRFGESKRELDALLTDETLANCPVLILGNKIDLPDAASEDELRNVYSLYGQTTGKGKVARSDLPGRPLELFMCSILKRQGYGEGFRWLAQYID

SEQ ID NO: 11877 - protein, 459 aa, Phyllotreta atra
MVYSVLSTPFLYFSYDYDLTHSLQRLHGISPDFWKQSLFERADQRFVWNGNLLYSFKGFSIHRFCLPLMHGFVSINFCVVNGHSLNWSIVSRRSVQRAGTRLHRRGLDKEGNVANFVETEQIIEYQGDRASFVQIRGSIPLFWQQDPDLRYKPPPTLLDVDPQDQHSMCLKHMNDLMTFYGKIVCVNLVDQKGAEGNMEMAMKNAINNVSSPSVKYESFDFHAECSKMRWDRLSILIDRLAHDQDEMSFFLLLRDGSLSSLQDGVFRTNCIDCLDRTNVVQSMLAHRNLESVLRKLQILHQNQTLEFQYSFEVLFKNVWADNADIISTQYSGTGALKTDFTRTGKRTRYGLLQDGMNSLTRYYKNNFADGMRQDAIDLFLGNGKPLSPLHIDKGWKYVTYPSILLIAVAMFVACAVTPSEYSTDSLLFLLFWGSMVYATLHTILKYGSEFVDKPRLTHS

SEQ ID NO: 11878 - protein, 501 aa, Phyllotreta atra
MPPTIQQNNQNAANGVEKRQVKTVEKRSDLLCKVKYCNTLPDIPFDLKFITYPFESIRFIQYNPTSLERNYKYEVLTEHDLGVSIDLINKDIYAIGAGAALDPADEKLLEEDILTPQDSKRSRHHAKSVSWLRRTEYISTEQTRFQPQTMDKVEAKVGYSIKKSLNNETLYMDRDSQIKAIEKTFDDTKTTIDKHYSKPNVVPVDVLPVYPDFSLWKYPCAQVIFDSDPAPVGKQVPAQIEEMSQAMIRGVMDESGEQFVAYFLPTEETLQKRREDVANQVQYQDEEEYEYKMAREYNWNVKSKASKGYEENYFFVVRSSGIFYNELETRVRLSKRRQKVGQPPSNTRLIVKHRPMDANEFRMQRYREKQLEPTGEDDEEMEIDEPQEEDNVLEPDNESRDKETESDNEKKRSRASSVSSQRRSRSRSNSSAKSNSRSSSRSASKSRSRSRSKSSSRSRSRSPSKSPSRSRSVSKSPSRSRSPSSARSKSASSSGSNSESE

SEQ ID NO: 11879 - protein, 389 aa, Phyllotreta atra
MPIENLEDQGLEKNPDLELAHYKFLLTLPEYRSDRNVHSKITEAIKKDDMAPWYELLCKEVGWKLDAALLKALKAKNAEKVKLLDEAIEDAEKNLGEMEVREAYLRKAEFYSRIGDKENAVSTFRQTYDKTVSLGHRLDIIFHLIRIGLFFMDHDLITRNIDKAKTLIEEGGDWDRRNRLKVYQGAYCMSVRDFKTAANLFLDTVSTFTSYELMDYKAFVRYTVYTSIISLPRNQLRDKVIKGSEILEVLHSEPFVKDYLFSLYNCQYAEFFSNLAEVETILRKDYFLNPHYRYYVREMKISAYTQLLESYRSLTLQYMAEAFGVTIEYIDEELSTFIAAGRLHCKIDRVGGIVETNRPDLKNAQFNSVVKQGDLLLNRVQKLSRVINI

SEQ ID NO: 11880 - protein, 5139 aa, Phyllotreta atra
MEELTSGLDPDDLMDLDEPEGSDLEEDDEDLIDDHVSSPFISSSAPESTANSVASSPIHEDFPPPFNFTGKPLHVKRGRGRPRREGGKPSAPRTTRGGGTGVSRVRRPRPPGFSRRGSLGGSRSVRQVDRSDYDMSLFTGSPVDDGLLDPETGSMIFPEKFVPAIEEPPYFPEHWPGKVCALCNLGERSQLGQGEMLRLNCPEGFSPEKVISEQILERALQAPDKECGDKSPKGPVTCRRQKSFNKCRHPSITSEYVDELTIIGYNEVPDVSSLFESNGQFYVHRNCALWSNGVTKAENSALLNVGPVVSQCSSKKCTFCNHYGASLTCHVDKCTKIYHFPCATAAGAFQDVSALTTLCNDHFGQVAMLTTASPCLTCGSMGDIANLMFCSGCGAHYHGICVGLAQLPGVRSGWQCRKCRCCQVCRVVGDESKLMTCEQCDKIYHASCQRPVVTSIPKYGWKCRCCRVCGDCGARTPGAGLSSRWHAHYTVCDSCYQQRNKGFSCPICHKAYRAHAHREMVQCSSCKKFVHGTCDPEADVVTYNQKKEISMDYEYVCLHCKNSTARQITAKRASIDDPSDVSASHDSLYDDTSEFDLPSPDEFARNMGLGKGKPYSANKIAKKRLSFTVNPVGRPKGTGKVPPGKMGYMKRYRLTEFNRKRGPKAKMRGIFGVPGVGLQRPISDGKTDEEPGVENRLVLCSAKDKFTLTQDICVMCGAFGTDQEGCLISCVQCGQCYHPYCINVKVTKVILQKGWRCLDCTVCEGCGQRNDEGRLILCDDCDVSFHIYCMDPPLDYVPHGNWKCKWCAICQSCGTTDPGFNCTWMNSSTQCGPCASHVNCPSCNEPYGEGDLIIQCVQCERWLHGACDFIKCEEDAEKCAEEGYNCILCRPRDVPPPHMVPAAVTPKPPTPTKSPELGKSTSYYMDGVCLSEFGSNLIKSLALEYHGSRKKRKKIPTVQDKEAGIMATIESVVAGGNVIPTNMEDSAKLELVDIKDEPQELYKEGMMWTKEDGPPPEGFTIITMENGLNVLRRKRQRNLQKLGIGGFVVRMRGIRTGQDNDDVDSSIGQSGLNANDIVPSPADGDKPRRKTIRRKLKSKLAETFPAYLQEAFFGKDLMDTVDCKKEEVDCYSSDDEKTDKHFKSINLSQDEIIAIVASGKTEKLENNNKDSTKEVKPTVLKEEEEDNPEDLKDVLALPGDLLDTDLVNSIMEDEEELSKTTASLVALDSNLQHDAELTDTLSSSGNSKETKDELSDILGPHFNLDSISNINSKDVEDIFKGVLTDESQESQESSSFSLQGNNMFSNNNAQQNVAQHPIINQAVRPKTLPTVNHNLNSPVSFPPPSPYHSEYSNSPQFSPAFTDSSCSWVGSNETPEIDSTNVTVTSTYNQRSSDKMKADESLGKSATISAVLYANINHPEWKKEYPNWPDRYKQIIKKWRTLSQEQKAPFLQHARDNRSQLRMKKAQQSQTVKETASTATSPNATKPPHQAGPALVTTLQAVTQQPAGAAAAPAPPVSEDQEKIALQQKSAREAEQERQWKQLQALRQQQTQQTQNILHEQRVQAIARVQRQISTDPAQQFINEQQSPLQVNTPQELSPSTTPAPSPRPFLGIKSPTFPVPSPVPPTGVRANTPSQSPHDISQPSTPDGNDHFIHSPTNPKPNFQPRLPNDPFAAQPATPRPQFGMARPPLQNFGGTVRNEQQDININRQLRELLQRQQVKKLDELLPGKAPPQRLWHANDQQEAGDASMTSAVVQGAGAQGTDATFRQPLPPGVVKPRLAISSVNRPILGTVRVNQLDPRIQNLDPRMRLILQHQQQRLATGIQQQFIRFTSNVRPTTVEQYEQLLQRQGNNQNQIHAEEQQQGVARIPIAQASVIQRPHVAQAVVTGATAVTTSTTESNPSEEGIPDNVTAELEKLEQETGTMVELQGVSDILGGLDDDDELLAEMGADFNILEYADPELEALTGGKTNILDLELEEEPVKKEKLASNANTCAPSQKPTPNVATTAISNSTAVTTPTEATAEPKIENTIQQSIPKSTPQQLQHPASLPQQQNMPQHGAQVQVQSQQSQPHPPQQMPIQSTLHIQQIHQQMVHQVQQAAAQGRPMPPGSKMQTTDGFVGVVMANNAVQLQIPPNYQQRLLLLQQLQNQKLMRVGSTQPRAALQVAPNQMPVGMNPGARMPVSAPPPPPPPYPGPPPPYPGNANQHQQEQPLLLEDLLEQEKREQEKLQNQPPNHEVTSSTGNETESALLSDQDFERLKADVFNSAPVSNISSTNQGNAAQTSQAWPQLQNRQAAVPAAASQHTMEVTTRVQMYNPNLIPAPPLPPENIATEQDKQAQLLYEQWLNHQNNSLVQQLRYYETEVQKLRKSKKSLNSKQRQLRKAGNQLTDADATELQRITAEQAILQKHLESSRKQNRQHGMLIQEYRNKHPAIKQRTVTDQIQSPLGHPASSPIQQSSASLSPMLSPSVSPMTQNSSPLNSPGPMVPSSPGHGPVQNILQSPNGANAAQMSPMQASPMQSSPRIGTPHSQSDESPGSAQSPSQVCLPPPMPRMTSPQHRRVVTSPVGMSQMRFINNNMLQQRVRMQSPIQNFQQKPGTPSPLNSPTSQQMNVNQQHQIQKQLQQQQQQQQQQTLLQQNLEGDPNAIHSQRTTQLLQHRNFIRQQVSQQQISPQTLTPQQHQLMLQQQKQLAQQQQQQIAQMNAARLQQQQQQQQQQQQQNNPPHSPMPPKSPMINQQIMSPHSMPQSPMQMPPKSPMVPFNPNQTNPNSPAARSPAFHQGMNQPTSPITHGHQPPSSPMPRSPMINQTHSPHNVRRPPSANSSPAMPDRPHSVENSSPRMYSIDQLVQESLANQNVNAQYNSYNSDMINESGGGNSNNPIPCPPEIPRFRYFKLGLRGGAPMWSFGRGAKRIPAPPNAKPDEPKAKKESHLSKVSILKRKPPMASIGKVGSLVSSDYNDLDDSSTTPPVTPPLASTSRGSLSKKKNLELQAQKDSVIVMHSPDDNNKQLEIMDYDDDNNTVLSSEVSLSSVARNDDDLVEIETISQDLAEGLSSPLESDQIGDEFLLFPGNMVVDMSGEEHYSEKEEEETVDGEYTDQNMHIVIRSPTTSDDEFIMPCKVKQYNADEQEDNPESPDQEEFGESGDMMASFDNEDTDIIISDQTAGVPEDSISTKEDFEELIDEGSRKNNISKQEVTAKHIQDFHRYTELFDYGKPEAQPVKKPVAKKFQPKVSLVRGVALPSKPNTEKIIITQNSNVLNTSQASKVTSIILTHNANVRRNIISVPKIVSTVSPAITIVSASTSQMASILPSKFTVPVISASAVRQLSNVKVIDKPSTSSLSISTRDNVLPKKIFEDDSVSPDSSNCDDEKSKDSFDDKVKSESPPQEVKQFVKSDSQVISLKSKNYADQSKKIEHLQIVNISAKDVVQRQRIPSPLISKASPVIIHNTPELKMTAQVIQESQTRMKITTTTDTEHYDESTDDTKSVVISIPSPTPSQEQMLDSIAFQALENRRREYDSIEDVLDMIENIENITAEPPEILEENTLQNSDSNSNIETKTAETKELQLPTSESEAPATKSSIVPQLSPLSQPTELTTNMANASQQLRTLLSSLQTTSTSSPTNVESIAKGFGQKISTSSSANQPIVASRVIGQQAGRQSPVITSVSTVIVPNFKQKITAATTATSRSSPVKVVSTSQQLTGSIITSTLNYIPNRTIGIQMVADQSKLPPASIVTTMQQINSITSSQESKKPSLTLTAMLQNQPAANMMTKSSADTITAASLLGSPISLPKTGFTTSLVQAQPSVVLSNTPPTPSQTSTATSSTKTTADSITAASLLGSSINIVKTSFAMQPSSTVGVVTSCVNKTPTSTTNLLHTQLTKVVRSKSVDDVKELVKIDENKQSVSSENVDDSNSGCKLSTITTVACNKTEDSQNVLLKKLLQNTACASAQSSPPASTSTVTTSAANTMSKVANTQCSTSASVEQPPVSAPSNVTVQRSASRDELLSPPQDVQTMVVIKKEPPLVPLSQPSPVLNSNSNAHTPEVKKEFIDESSQHSEVSDHSRSDAPIKEELETMENTAEKMMLDKEELKKQKRRMYQQKRRQNQILNKELAQQQPKKRPRKNSKIDEDYDTYIDGVLAQLRQLPPIAVSEPVLNRNFGVVPLFGCGDLAKIGAKDYSTHLGELTGNYGYGELPGFTDFYSTKPYGDMDPLPEKPPSSTQRGFYDQEFPLIRFDADEHKKFDVFCREDSPDSILSSSSPECTREPEGKFVGLKLISDSEEDEEDDAKDAVSKGRMSPVVPVIKPVPIRLKPAGELYFKENLNENKENINSDSLHVMTKSKFDNKQSPPSNVSGHVTVTLTLTSSAAEDIMGVLRDLANILHIPAPTSYQIVERTASPPSQKLGLYRTKGKDGKEGAPIDIQSILNGATKFCKHCDVIILSNIIRRKVSDLPFLAKDSDLLSDGEELFFCSSACYMQFALMHRSPSISEDKAAEIINHLSQKDNLDSKQKLPADALDSSKSIAQKLSFNIKDTKREFEPMETNDAFAFFARTTANKQGNNFYDGAPFKSVPARVHRNDRYKLWTPGCLQPTQKHKTPTDKEIMELLYRMQITVTPPVMPEDTRKCLFCHGIGDGVADGPARLLNFDVDKWVHLNCGLWSDGVYETVNGALMNVENALQSGLLATCVHCQSIGATIKCFKTRCSSIYHLNCAVKDNCVFYKNKTVFCKVHAPKNEKDNELTTLSVSRRVYIERDENKQVAAVMHHSDSTDLLRVGSLIFLSVGQLLPHQLQNFHTPNHIYPIGYKIIRFYWSMRNLNKRCKYICTIREVSGKPEFRVMVQEPPEADVEFSDSTPKGAWQKILDSVATIRKENNCLHMFPKFATGEDLFGLTEPAIVRVLESMPGIETLSDYKFKYGRNPLLELPLAINPSGSARTEPRLRSQLHWKKAHTQRTTGGTSSIRPMFGPSLTGSISTPAQGELACPYSKQFVHSKSSQYKKMKQEWRNNVYLARSKIQGLGLYAARDLEKHTMVIEYIGEIIRSELAECREKQYEARNRGIYMFRLDEERVVDATLCGGLARYINHSCNPNCVAETVEVDRDIRIIIFSKRRILRGEELAYDYKFDIEDDQNKISCMCGAPNCRKWMN

SEQ ID NO: 11881 - protein, 1368 aa, Phyllotreta atra
MFSTMPTKQKTAAKVDDDEMLSEILGEIDSGTANTSAIEKPKISKYSTLAINLSAKDYMRNFSQPVKKRAIEKNVQPSVPKPVIKLNKKLTKSIQPIKIEDTKNETIEPDEHIDKEKADPDTSHFDDDLDETLLEEISEDLNKTATESQITESEMNEDDFPGDFDTTVIDEIEERINIASEQLINDIQAEVETEWQYFNDANKSFKIATVDSGDTDSIASEDTDSIADSPAVTTADTPFVEVEGNSVFRFFWWDAYVDPLHQQGTVFLFGKTYCETSKKYESCCVAVKNIERTLFVLPRPFEVDEDGNPTDKPVTFKAVHDEFNNKILKRLGIGSFKSRLITKKYAFDASIPAESEYLEIRYSASFSRIRCGDEDCDQKDGYDYIEGDLGYSTFSKIFGTKTNFLELLFLERKIKGPCWIDISDPEPATNPMSFCKFEVNCLKPTNLKITTFIKPVPPPPLVVATINMRNCINRASSNHEIVMLSCLVQNSYAVNKPPPEPAFQQHFCVFSCPRGEVLPLNLYDTLENYKITKVLKTDNEKAMLNCFVHNIVQIDPDLIVGHNLQGYQATILADRLVKLNCRSSNRLGRLKKKTTQAKQLEKTLFLGRLVCDIKISAKELIKSRSYDLDTLCQVVLKLKENQRVDLEPEDVFKMFKTSQDLIKLISFTMQDSGYIMKMMYNLNIVPLALQITNIAGNVMSRTLMGGRSERNEFLLLHAFHEKGYILPDKVYRRIESESKGSSKKKPTYSGGLVLEPKVGFYDKLILLMDFNSLYPSIIQEYNICFTTLPVMDSDENLVLPDSNQPAGVLPTEIRKLVESRRQVKSLMKKPDVPKDLKLQYDIRQMALKLTANSMYGCLGFGHSRFYARNLAALITQKGREILVNTKDLIEKMCLDVVYGDTDSLMINTNILEYDQVFKVGVKIKQEVNKLYKQVELDIDGVFKYLLLLKKKKYAAVSLSKSPSGELIATKEYKGLDIVRRDWSQLSSETGKLVLEHLLSDQSADEKVQNIYDYLSKIKSDLVEGKVPIPLLVITKQLNKAPHMYTDKNSMPHVQVALRYNKKSRDHFRMGDTVPYVICVDNTSNNPMQRAYHLDELKGNPELKIDYDYYLEQQIHPVIARICEPIEGLDAYQLAECLGANLKRMKRPKPQGGNENIQGENVVKAEVKFKNAEKFTFVCYICKHQNVVSEPLVNNIPFLETCQNSDCKSKPIDYLPSVQNQLYLSIRSHITKYYQKVLTCEDPSCPNAPRRLPLKFLKKRPICNTCGNAVMYRVYTEFHLYNQLAYYRYMFDLSKLKNKPLMDGETESGYRTLLDTVEKFMNQSEYSLINLSEVFGQLGWAAPVEKRVLEESGNGIHFNEEGSEDVYDE

SEQ ID NO: 11882 - protein, 465 aa, Phyllotreta atra
MAAAAAAKIAEVRETTRVERIGAHSHIRGLGLDDSLEARHVSQGMVGQVSARRAVGIVLQMVRDGRIAGRAVLLAGQPGTGKTAIATALAHALGQDTPFTSMAGSEIYSLEMSKTEALTQAIRKSIGVRIKEESEIIEGEVVDLSIERPATGVGTKVGKLILKTTDMETVYDLGGKMIDSILKEKVQSGDVITIDKATGKITRLGRSFARARDYDATGQQTRFVQCPEGELQKRKEVVHTVTLHEIDVINSRTHGFLALFSGDTGEIKSEVREQINGKVAEWREEGKAEIIPGVLFIDEVHMLDIECFSFLNRALENEMSPIVIMATNRGITKIRGTTYKSPHGIPLDLLDRTIIVPTQPYDEKELKEILNIRCEEEDCQMSDNALVVLTRICKETSLRYGMQLIMTSSLIARKRKAHEVDVEDIKRAYQLFFDEGRSVQFLKEYQQEFMFNEIDEKDDMEMETV

SEQ ID NO: 11883 - protein, 371 aa, Phyllotreta atra; identical to SEQ ID NO: 11653

SEQ ID NO: 11884 - protein, 227 aa, Phyllotreta atra
MQAIKCVVVGDGAVGKTCLLISYTTNAFPGEYIPTVFDNYSANVMVDGRPINLGLWDTAGQEDYDRLRPLSYPQTDCFLLCFSLVNPASFENVRAKWYPEVLHHCPRTPIILVGTKLDLRDDPASFENVRAKWYPEVLHHCPRTPIILVGTKLDLRDDPKSIEKLKERRLFPITYTQGLQMAKEIKAVKYLECSALTQVGLKQVFDEAIRAVLCPPPVKKKKSCSVL

SEQ ID NO: 11885 - protein, 1339 aa, Phyllotreta atra
MNASTFNPRMEAAQNPVQKMELASRNVENSLLIDNNAPRLIDFMNINPQSGSTASGFADHDYPTLSGLSHIINSMTQIKCVSNVPIPSEIVDHFARVQCHCMMGLFSEINRAWLTVDSDIYVWTYEENTDLAYFDGISETIVCVGLVKPKPGVFHAFIKYLLILATSVDIVVLGVTFTERPGDNADEIQLIPDPVFILPTDGSTVTIINSTDDGRIFYGTKEGNLFEIAYQAESGWFGKRCKKINLSTSTLSFLVPSFINAALSEEDGITQISIDDSRHILYILTEKGSIEVCDLGDKGNSFSRISKISQNTLVNQAMNTVKTLDSQNFRPIVSISAIEASESVNLNLVAVSQTGVRFYMSVTSLSNQNPNQRPYTLTLAHVRLPPGYSANITVRPRAVHVSQYRDRNLILISTVNEKDVLWCMSSDLFPFGRGLTEAYTAINLDGPALAISEVRNGSPLQIKDLHEAPPLVVRQHAEPPKKYIVLTSHSIQIFIKLRPVDVLKQILKDSHGQDTEALKAFFTIQKEDQACATALILASLENEDNMDIAEFATRAFFLFGGEPKLVAPINTFSGPSVFCPPVMSTPNIHQYQQQQQFQPSPQYQHNFPHAISPGANAYELTSPFVFSPKHNGLYLYLSRILRPIWNRRTVDKLCLDGKIVTNHSTVTSEDCIFILNYITSLHNFLMRNTQLSTLSAGPGPGQNPQTFNNTTINMTRLNHTIQDVQLEERASLDALKTFVCHCCQILGLWRILCEHQFHTLIASLPETEQQILQNTTFKDLLLYRHDICSLLIATLVDSYLGDNASVDSISSKLREVCPLFYKTEDAAFSKAVEILKMTRAIQNNDEKEEMIQSALQICKSIGPTINITDICKEFANLKAYKAVTELCAHFGKKIDPDKIAESYYNAEDNSGDQEGYNYYQRRLEIYRHILNMLDQLYNEQNQTQVTSRDTSYSVNQTILLDGVEQSQVGYVMKQVIKDVMETPDEIMHFALYDWLVFKNMTGDLINIQNPSLETYLKRTSTQNPNNIEAMNLLWKYYESCNNHAAAAKILNNLASRTGINVPLKERLSYLARAIMCMRSDKIGYAPYLGVFLRDLEDKMEVAKVQEQILDAIVNLQGQIPNAQEAISALNAGLYEISQLYENFAEPFKLLECQLAIIECAGYTDQVLIESIWQQILTEELRKTYGTGTDKVCQLLNKVKQLSKQYAQSANCFPLNYIVYELEIVNAKLRGDKQLVPCALESMNIPFENLINVYNSLNTISINDHFWQLEENEFHLSEATAALINCFLSHLEQYSSVEKRKITSLCQDAVVALLSNLYSKPNTEVLVNKLRNIQAKLSRI

SEQ ID NO: 11886 - protein, 1380 aa, Phyllotreta atra
MSEFTLSYREVTPEQIDFENWKEITLTTGGTQSTLQDIKVAEKANGYCYKDSTKHCTRNRFIYWRINHNVLELVEHSLDINLTGNRIRYKFDTPILDGVSIHEVLDNIVILVPTVCSVHRLIFPHPNVFHAQDDLLGIYPDLTALSIFSKASIVDTRNPNSFYVFNNPSTANDQLPNLANSYFVPETGEAYFVLAFPSTELLLIRQSPDQVTCAELKGESLVPRFFAGIADKFRQRNSDSENVVSLLFYDLDEETYVLSLTQDAHLKFWSCSKGQCVAVIDVREKIRTNLKYRVQSAILKKAEDGNSSENILVLFLSFGNKCQFHILKPSIREQEITLNRLATLESPLNDLIDFAAQIDCLWSVWRSEEGETVVYNASFKSNRWTQVILETEPCEFKYIPIKHNDVKTLYLQHIFHPGRFPLHVINKTLSIYKMPTIASDSHLSVSALKQRVCLAVENDIQNLFNNGSDIDSVEVDEYVECAEWSWQKFYTYCVQYHTASRKPLGLMLLPSVSGAMFLKKSVFSFLRPVDSLEHMTLCTDLYREQFYNFSMLSEDLDTVDDVINVFKVIVYIEQQLKDVFMQSFETELLNLQSPDVVTEELLKRIYVEMDSDFFSHILHLIKDVNDLYKAIHKILELLRYENTLANPDNDINPSAMYYFNSLLGTSLVAQSFRQQAEIRFQICRNLLLLCNFLVMDRTLDWGVLEGVRSVCMPDIVVLTQASFVVLWLSGLTMFESDSIRDSSMSILNPLKLTPVYNLLPFTRCTSLLEVFISSSGVQDARKSFARVSCKDEALVHWHWSLLPYVNHIRHLIWPISGCTVLEEWLLSSGQHVWLQQYVRLLSNWCEWNACTRNFLLASSFLTTGEFYKAEELFETAAKGVFTDAFLKNRIKSVDDSNFRTTIHYYLKVIQLFELCNARNHVIYVANTALCVVKRDDPLAATLFSIKFKHHLALKHYQLAFDSLNSNPDGERRKDNLRDLVKTLLDEKKLNVLLNFTYGSMDEFFANIILTRARAADVNNNVFYDFLYSYQIKKGPPSFRLAASAMYEQAFRLSQKTTIEALEKQVKCYLAAKNVLHLCPSQHAWVVRPADPDEEDEQIIFQPLAGSNGEIRTFKIKKQIEVVDIETIGKELTFASAKLKLLQFNPTVSINMYDPLELVISLNNSGMFKVAFEICSTFDLPYSLVFEALTKRCVLLTEAEDPNAWNWLVENDLQDLPVNRESAADVVWKFLQDCLEKYEEPHMSCLHNVVCKKIINMQIYLPHWLKASYKSRNPSELLRLLHASGRLEEAVELAKDYILSAMGYGKEEFGFKQPLAPTSPAFCLPVYAIQRLVDELNIQNSMNIEKPYVHEYDDLNVLFTKYLETAIRVSNQMCQVKCKAF

SEQ ID NO: 11887 - protein, 753 aa, Phyllotreta atra
MEVSDKNLETLSRYLQETLNPDPNVRRPAEKFLEGVEVNQNYPLLLLNLVHKPEAAMTIRVAGSVAFKNYIKRNWLVEDDQADRIHESDRLAIKNLIVTLMLSSPESIQKQLSDAISIIGKTDFPLKWPELITEMVEKFSTGDFNVINGVLRTAHSLFKKYRYEFKSNELWTEIKYVLEKLAKPLTDLLVATISLSQTHANDVAALKIIYSSLVLICKVFYSLNFQDLPEFFEDNIQIWMTNFHTLLSVDVKSLQSQEDSEAGVLEQLKSQVCDNVALYAQKYDEEFQPYLPQFVTDVWSLLVATNLQPKYDLLVSNALQFLSSVAERSQYRNLFEDDNVLSSICEKVIIPNMEFRTSDEELFEDNPEEYTRRDIEGSDIDTRRRAACDLVNTLSQNFEQRIVEIFGRYLQVMLAKYAENPKEFWRSKDAALYLVTSLVSRGSTQKHGVTQTSQLVDITQFCRQHILPELERPDVNDLPVLKADAIKYVMTFRSVLPSDLVVSTLPQLIRHMPSESCVVHTYAACTLEKILMLKSNNQAIVTGAQLEPLASELLTNLFAVLQKPVSEENEYIMKALMRTFATLQDRIIPYLNVALPKMTEKLRMVAKNPSKPLFNHYLFECFSLAIKIICKVNPTAVTSFEDILFPIFQGILQQDIQEFIPYVFQILSLLMEHTPQGSLSEPYMQLLPCLLAPILWERPANISPLVRLLAAFATQAAPQIVLQDKVVFIYLFITSIPTPKLKTKTVCRLNLHR

SEQ ID NO: 11888 - protein, 199 aa, Phyllotreta atra
MAKVQLCNITVMDNPSPFLNPFQFEITFECIEELKEDLEWKMIYVGSAETEEHDQILDSVFVGPIPEGKHMFVFQADPPNVSRIPENDAIGVTVVLLTCSYKSQEFIRVGYFINNEYSDPEMRENLPSPPQFDKVIRNILASEPRVTRFKINWEESSGTQENGTTIAEAPANQTTETSTSVEVPAFNENSNSWATMECS

SEQ ID NO: 11889 - protein, 312 aa, Phyllotreta atra; identical to SEQ ID NO: 11659

SEQ ID NO: 11890 - protein, 151 aa, Phyllotreta atra
MAAMRSMSRLLFSRSMQTTVKRGYADQMSFTFAAGNQVFYNATSIKQVDVPSFSGSFGILPAHVPTLAVLKPGVVTVYEDAGNVKKIFVSSGTVTVNDDSSVQILAEEAHPVENLDVSAARDLLNKAQSQLSSATTDQARAEAAIAIEVGE

SEQ ID NO: 11891 - protein, 323 aa, Phyllotreta atra
MSGDGNQNEHFDTLFLSIAQHHPQGPTQLLDTFVNFLSRKTDFFTGGKEGEWEKLVLNTFKKYEKSSREQHAAELKEKQEQEARRKAKKEAESAKQAQITELTEEQAEKLQAELDAKKSPASAATSNSSSGPSTSTAKIEEDEDESEKGKLLPNKGNGCDLDKYNWTQTLSDIELRVPLRCNFRAKQKDLTVNLTKKHLTCGLKGHPPIIDDDFQHEIKLEETNWVIEDGKSLLFSIEKVNKMNWWSKIVKNDPEISTKKINPEPSKLSDLDGETRGMVEKMMYDQRQKEMGLPTSDERKKQDVLKKFMEQHPEMDFSKCKFN

SEQ ID NO: 11892 - protein, 167 aa, Phyllotreta atra
MQSPSGMVHGHPGASILQWSPDKKYSDRERWICVYPAYINCKKTIAQGRKINKEKCVENPTHQEIRDVLLAAGLKVGVENKLYSRERSKELLYRGRIRVQLKNDDGTLCNPNFPTRDSLMLHLGDMIPKLKSRQNKGSGDPQPTTTSSKGKGKGKGWRRKQIVQQRT

SEQ ID NO: 11893 - protein, 732 aa, Phyllotreta atra
MEEPEPTKRQKMPKVAKVKNKAPAEIQITAEQLLREAKERDLEILPPPPKQKISDPAELADYQLRRRKQFEDNIRKNRAVISNWIKYAQWEESQKEIQRSRSIWERALDVDHRNITIWLKYTEMEMRNRQVNHARNLWDRATVLLPRVNQFWYKYTYMEEMLENVAGARAVFERWMDWQPDEQAWQTYINFELRYKEIDRARQIYERFVITHPEVKHWIKYARFEENHGFIHSARQIYERAVQFYGDDHLDEKLYIAFAKFEENQKEHDRARVIYKYALDHIPKDETKELYKAYTIHEKKYGDRSGIEEVIMSKRKLQYEQEILQNPTNYDAWFDYLRLVEGEADLEITRETYERAIANIPPSKNKQYWRRYIYLWINYALFEELEAKDYERTRQVYKACLEILPHKTFTFSKIWLLYAQFEVRQKHLKAARKVLGMSIGMCPRDKLFRGYIELEIQLREFDRCRKLYEKFLEFGPENCVTWMKFAELETLLGDTDRARGIYELAINQPRLDMPELLWKAYIDFEISQEEPNNARQIYERLLERTSHVKVWLSYAKFELNNPSEEDFNIRLARRIFERANENLKNVPEKESRVLLLENWREFENNHGDEAHKEKVNAKMPKRIKKRQKVIDEDGVEQGWEEVFDYIFPEDEASRPNLKLLAAAKNWKKNTDEPEEDTENRTTLSSSSQRMKEKLLASVKNWKNNDKENSDSNNDDCSNEEEVQVVSNNEVEN

SEQ ID NO: 11894 - protein, 476 aa, Phyllotreta atra; identical to SEQ ID NO: 11553

SEQ ID NO: 11895 - protein, 151 aa, Phyllotreta atra
VELVCLPKVLEYSRFKLYFKYSTIMSTVSSSAVELSSYRDQHFKGSRAEQDKLLRLSTTLYVGNLSFYTTEEQIYELFSKCGDIRRIVMGLDKYKKTPCGFCFIEYYNREDAENCLRYINGTRLDDRIVRTDWDAGFIEGRQYGRGKTGGQ

SEQ ID NO: 11896 - protein, 306 aa, Phyllotreta atra
MAATVGRICGVGLLKPNNLTTIGQINSYSTAKEWSRGKKALLGTLGLLAGGTGAVLVALDQSVKASDLELHPPKNIWSHSGIFSSLDHASVRRGYEVYKQVCAACHSLRFVAYRNLIGVTHTEAEAKAEAEDQMIEDGPNEEGNMFKRPGKLSDYFPSPYPNEEAARAANNGAYPPDLSYITSARHGAEDYIFALLTGYCEAPAGVVVREGQYYNPYFPGGAISMAQALYNETIEYGDGTPATASQLAKDVSTFLKWTAEPEHDDRKRMLIKAIGIFSFLLGITWYIKKVKFASLKSRKIEFRPKK

SEQ ID NO: 11897 - protein, 462 aa, Phyllotreta atra
RAHVSEFQFENQRRTFTSYGYALDPSVTNDGKIKVVGSSEADDNSIKTVFEASKTRPLDKRKRKKNDDPSDVEGFLGPWGGFIDEQKVSKPTEEEQIELDEISSKKNKKGKPNEDKPLEEKSVLHIKDAVDYQGRSFLHAPQDVGVNLRSDTPPEKCFLPKAHIHTWTGHSKGIAAIRLFPRTAHLLLSAGMDCRIKIWEVYNERRCVRTYYGHRQAVRDINFNNSGKHFLSAGYDRYIKLWDTETGQVLSRFTSRKIPYCVKFNPDKNKQHLFVAGTSDKKIICWDTRSGDIVQEYDRHLGAVNSITFVDENRRFVTTSDDKSLRVWEWDIPVDMKYIADPTMHSMPSVTPAPNGKWLACQSMDNKVVIFSSMNRFKINRKKTFSGHMVAGYACSLDFSPDMSYLSSGDADGKVYIWDWKSTKLFKKWKAHDNVCISVLWHPHEPSKLISAGWDGLIKYWD

SEQ ID NO: 11898 - protein, 244 aa, Phyllotreta atra
MVQKKPKKKVGKKVAAAPLAVKKVEQKKEVNPLFEKRPRNFGIGQDIQPPRDLSRFVKWPKYIRIQRQKAVLQKRLKVPPPINQFSQTIDKQTATQLFKVLEKYRPETALQKKNRLKAKAEAKVAKKEEAPAKRPNTLRAGTNTVTKLVEQKKAQLVVIAHDVDPIELVLFLPALCRKMGVPYCIVKGKARLGLLVRRKTCATVALTQVDSGDRSNFNKLLEVIKTNFNDRADEIRRHWGGGIL

SEQ ID NO: 11899 - protein, 333 aa, Phyllotreta atra
MATIIKDITLQENIPQNILFEKHIDFIKEYGQKENNFEYAMTDYLRISGMYWGLTALELMNASPPHSIDEISDYIKQCQDPESGGISSCLNHDPHILHTLSAVQILCMYDNLKAIDVEGVVKYVKNLQLPDGSFTGDKWGEVDTRFSFCAVATLSLLDRMDVIDVNKAVDFVDSCKNFDGGFGSRPLSESHAGLIYCCLGFLSVTNRLDVVDRDMLAWWLCERQLPSGGLNGRPEKLPDVCYSWWVLSSLTILGKLHCIDANALKKFILACQDTESGGFADRPGDIPDPFHTVFGISALSLLGNDTVQKVNPTYCMPQHVIDRLQLKPQILDD

SEQ ID NO: 11900 - protein, 888 aa, Phyllotreta atra
MHQETLQLIQILEKTVSPDKNELEQASSFLEQASQTNLLGFIKTLSDILRHGGNSPVARMAAGLQLKNQLTSKDATIKATYQQRWLVFSEEVRDYIKKNVVGALGTETNRPSSAAQCVAYIAVTELPQGQWPDLISTLVSNICQGNSTEMQKEATLEAIGYICQEIESDVLVTQSNDILTAIVHGMRSSEPSNHVRLAATQALLNSLEFTKANFDLPTERNYIMEVVCEATQSPVSQIKVAALQCLVKIMSLYYQHMEPYMAPALFPITLEAMKSENDAVALQGIEFWSNVSDEEVDLAIEDTEATEAGRPPTRVSRHYAKGALQYIIPIILQKLTKQEELDDEDDWNPSKAAGVCLMLLATCCEDEIVPHVLPFIKENIKSDNWRFRDASLMAFGSILGGLEPNTLRPLVEQAMPTLIELMYDNSVIVRDTAAWTFGRICEIIPEAAINENYLKPLLESLITDLKAEPRVAANVCWAFSGLAEAAYEAAAVNEETGAPDTYILSPYYEFIIQRLLETTDRADGAQANLRPAAYEALMEMVKNSPKDCYVTVQKTTMVILERLQQVLQMENHIASHNDRSQFNDLQSLLCATLQSVLRKVTPEDAPHISDAIMTAMLTMFNSNSCKSGGVQEDALMAVSTLVEVLGENFIKYMDAFKPFLYIGLKNHQEYQVCGTAVGLTGDIFRALKLKVLPYCDEIMTLLLENLSDQSVHRSVKPQILSVFGDIGLSIGSEFKKYLDVVLSTLAQASQAQVDRNDFDMMDYLNELREGVLDAYTGIIQGLKGDGPSPSPDVMVLEPHIPFIVQFIIVVAQDAEHSDGTVAVAAGIVGDLCTAFGSSMVPLLDLASINDMLAQGRRSRVSRTKTLATWASKELRKLKMPPSAAAASW

SEQ ID NO: 11901 - protein, 406 aa, Phyllotreta atra
METILEQQRRYHEEKERLIDAMVKEMLHKKNTYREAINSDHRQKYLLDRYMTSTERLIDLYEDKDGQRKAEVAALTGPNEFNEFYSRLKQIKDFYRRHPNEISVPMSVEFDEFAKARENPNEDMANFVEFTDEEGYGKYLDLHECYEKYINLKGIEKVDYITYLAMFDQLYDIPKERKTGEYRKYLLYLIEYLTWFVQRIRPLMDLDSDLQEQADQASGGWENGTVPGWPKETGSALANVGAHLDLSAFSSWEELASLGLDRLKSALMALGLKCGGTLEERAQRLFSTKGKGSLDPSLMTKNSKNRVTKEKEALRQRELATLEAQIYRLADLVSAQRAATKENVQRKQARTDGERDDSENEESEEESPDEADDDVPYNPKNLPLGWDGKVSRAKRDRELIVLETNG

SEQ ID NO: 11902 - protein, 212 aa, Phyllotreta atra; identical to SEQ ID NO: 11446

SEQ ID NO: 11903 - protein, 291 aa, Phyllotreta atra
MNFGDLEFGFKISRKTIPLIVRETCLAIWNVIQPQEIPFPTKELWLEKSKEFYEITQFPNCIGSIDGKHIRIICPPNSGSEYFNYKKYFSIVLLAVADANYYFTAVDIGSFGREGDSTIFKKSNFGLRLKNNELDLPADNPLPVPDNVEQGSEVPYVLLGDEAFGLSKHVMRPYPSKGLSQEKRIYNYRHCRARRVVECSFGILSNKWRVLHSSMLIHPEFAVIVVQACCVLHNFVRRRDGYLFEDTLTCPLQDVQESAVVGGMSKGIDVREVFCQYFNGSGALSWQNKYV

SEQ ID NO: 11904 - protein, 5179 aa, Phyllotreta atra
MEELTSGLDPDDLMDLDEPEGSDLEEDDEDLIDDHVSSPFISSSAPESTANSVASSPIHEDFPPPFNFTGKPLHVKRGRGRPRREGGKPSAPRTTRGGGTGVSRVRRPRPPGFSRRGSLGGSRSVRQVDRSDYDMSLFTGSPVDDGLLDPETGSMIFPEKFVPAIEEPPYFPEHWPGKVCALCNLGERSQLGQGEMLRLNCPEGFSPEKVISEQILERALQAPDKECGDKSPKGPVTCRRQKSFNKCRHPSITSEYVDELTIIGYNEVPDVSSLFESNGQFYVHRNCALWSNGVTKAENSALLNVGPVVSQCSSKKCTFCNHYGASLTCHVDKCTKIYHFPCATAAGAFQDVSALTTLCNDHFGQVAMLTTASPCLTCGSMGDIANLMFCSGCGAHYHGICVGLAQLPGVRSGWQCRKCRCCQVCRVVGDESKLMTCEQCDKIYHASCQRPVVTSIPKYGWKCRCCRVCGDCGARTPGAGLSSRWHAHYTVCDSCYQQRNKGFSCPICHKAYRAHAHREMVQCSSCKKFVHGTCDPEADVVTYNQKKEISMDYEYVCLHCKNSTARQITAKRASIDDPSDVSASHDSLYDDTSEFDLPSPDEFARNMGLGKGKPYSANKIAKKRLSFTVNPVGRPKGTGKVPPGKMGYMKRYRLTEFNRKRGPKAKMRGIFGVPGVGLQRPISDGKTDEEPGVENRLVLCSAKDKFTLTQDICVMCGAFGTDQEGCLISCVQCGQCYHPYCINVKVTKVILQKGWRCLDCTVCEGCGQRNDEGRLILCDDCDVSFHIYCMDPPLDYVPHGNWKCKWCAICQSCGTTDPGFNCTWMNSSTQCGPCASHVNCPSCNEPYGEGDLIIQCVQCERWLHGACDFIKCEEDAEKCAEEGYNCILCRPRDVPPPHMVPAAVTPKPPTPTKSPELGKSTSYYMDGVCLSEFGSNLIKSLALEYHGSRKKRKKIPTVQDKEAGIMATIESVVAGGNVIPTNMEDSAKLELVDIKDEPQELYKEGMMWTKEDGPPPEGFTIITMENGLNVLRRKRQRNLQKLGIGGFVVRMRGIRTGQDNDDVDSSIGQSGLNANDIVPSPADGDKPRRKTIRRKLKSKLAETFPAYLQEAFFGKDLMDTVDCKKEEVDCYSSDDEKTDKHFKSINLSQDEIIAIVASGKTEKLENNNKDSTKEVKPTVLKEEEEDNPEDLKDVLALPGDLLDTDLVNSIMEDEEELSKTTASLVALDSNLQHDAELTDTLSSSGNSKETKDELSDILGPHFNLDSISNINSKDVEDIFKGVLTDESQESQESSSFSLQGNNMFSNNNAQQNVAQHPIINQAVRPKTLPTVNHNLNSPVSFPPPSPYHSEYSNSPQFSPAFTDSSCSWVGSNETPEIDSTNVTVTSTYNQRSSDKMKADESLGKSATISAVLYANINHPEWKKEYPNWPDRYKQIIKKWRTLSQEQKAPFLQHARDNRSQLRMKKAQQSQTVKETASTATSPNATKPPHQAGPALVTTLQAVTQQPAGAAAAPAPPVSEDQEKIALQQKSAREAEQERQWKQLQALRQQQTQQTQNILHEQRVQAIARVQRQISTDPAQQFINEQQSPLQVNTPQELSPSTTPAPSPRPFLGIKSPTFPVPSPVPPTGVRANTPSQSPHDISQPSTPDGNDHFIHSPTNPKPNFQPRLPNDPFAAQPATPRPQFGMARPPLQNFGGTVRNEQQDININRQLRELLQRQQVKKLDELLPGKAPPQRLWHANDQQEAGDASMTSAVVQGAGAQGTDATFRQPLPPGVVKPRLAISSVNRPILGTVRVNQLDPRIQNLDPRMRLILQHQQQRLATGIQQQFIRFTSNVRPTTVEQYEQLLQRQGNNQNQIHAEEQQQGVARIPIAQASVIQRPHVAQAVVTGATAVTTSTTESNPSEEGIPDNVTAELEKLEQETGTMVELQGVSDILGGLDDDDELLAEMGADFNILEYADPELEALTGGKTNILDLELEEEPVKKEKLASNANTCAPSQKPTPNVATTAISNSTAVTTPTEATAEPKIENTIQQSIPKSTPQQLQHPASLPQQQNMPQHGAQVQVQSQQSQPHPPQQMPIQSTLHIQQIHQQMVHQVQQAAAQGRPMPPGSKMQTTDGFVGVVMANNAVQLQIPPNYQQRLLLLQQLQNQKLMRVGSTQPRAALQVAPNQMPVGMNPGARMPVSAPPPPPPPYPGPPPPYPGNANQHQQTGLRMGPGLLPMGHFHPSTLQGFPMHPHLQRRPLLLEEQPLLLEDLLEQEKREQEKLQNQPPNHEVTSSTGNETESALLSDQDFERLKADVFNSAPVSNISSTNQGNAAQTSQAWPQLQNRQAAVPAAASQHTMEVTTRVQMYNPNLIPAPPLPPENIATEQDKQAQLLYEQWLNHQNNSLVQQLRYYETEVQKLRKSKKSLNSKQRQLRKAGNQLTDADATELQRITAEQAILQKHLESSRKQNRQHGMLIQVYMKEYRNKHPAIKQRTVTDQIQSPLGHPASSPIQQSSASLSPMLSPSVSPMTQNSSPLNSPGPMVPSSPGHGPVQNILQSPNGANAAQMSPMQASPMQSSPRIGTPHSQSDESPGSAQSPSQVCLPPPMPRMTSPQHRRVVTSPVGMSQMRFINNNMLQQRVRMQSPIQNFQQKPGTPSPLNSPTSQQMNVNQQHQIQKQLQQQQQQQQQTLLQQNLEGDPNAIHSQRTTQLLQHRNFIRQQVSQQQISPQTLTPQQHQLMLQQQKQLAQQQQQQIAQMNAARLQQQQQQQQQQQQQNNPPHSPMPPKSPMINQQIMSPHSMPQSPMQMPPKSPMVPFNPNQTNPNSPAARSPAFHQGMNQPTSPITHGHQPPSSPMPRSPMINQTHSPHNVRRPPSANSSPAMPDRPHSVENSSPRMYSIDQLVQESLANQNVNAQYNSYNSDMINESGGGNSNNPIPCPPEIPRFRYFKLGLRGGAPMWSFGRGAKRIPAPPNAKPDEPKAKKESHLSKVSILKRKPPMASIGKVGSLVSSDYNDLDDSSTTPPVTPPLASTSRGSLSKKKNLELQAQKDSVIVMHSPDDNNKQLEIMDYDDDNNTVLSSEVSLSSVARNDDDLVEIETISQDLAEGLSSPLESDQIGDEFLLFPGNMVVDMSGEEHYSEKEEEETVDGEYTDQNMHIVIRSPTTSDDEFIMPCKVKQYNADEQEDNPESPDQEEFGESGDMMASFDNEDTDIIISDQTAGVPEDSISTKEDFEELIDEGSRKNNISKQEVTAKHIQDFHRYTELFDYGKPEAQPVKKPVAKKFQPKVSLVRGVALPSKPNTEKIIITQNSNVLNTSQASKVTSIILTHNANVRRNIISVPKIVSTVSPAITIVSASTSQMASILPSKFTVPVISASAVRQLSNVKVIDKPSTSSLSISTRDNVLPKKIFEDDSVSPDSSNCDDEKSKDSFDDKVKSESPPQEVKQFVKSDSQVISLKSKNYADQSKKIEHLQIVNISAKDVVQRQRIPSPLISKASPVIIHNTPELKMTAQVIQESQTRMKITTTTDTEHYDESTDDTKSVVISIPSPTPSQEQMLDSIAFQALENRRREYDSIEDVLDMIENIENITAEPPEILEENTLQNSDSNSNIETKTAETKELQLPTSESEAPATKSSIVPQLSPLSQPTELTTNMANASQQLRTLLSSLQTTSTSSPTNVESIAKGFGQKISTSSSANQPIVASRVIGQQAGRQSPVITSVSTVIVPNFKQKITAATTATSRSSPVKVVSTSQQLTGSIITSTLNYIPNRTIGIQMVADQSKLPPASIVTTMQQINSITSSQESKKPSLTLTAMLQNQPAANMMTKSSADTITAASLLGSPISLPKTGFTTSLVQAQPSVVLSNTPPTPSQTSTATSSTKTTADSITAASLLGSSINIVKTSFAMQPSSTVGVVTSCVNKTPTSTTNLLHTQLTKVVRSKSVDDVKELVKIDENKQSVSSENVDDSNSGCKLSTITTVACNKTEDSQNVLLKKLLQNTACASAQSSPPASTSTVTTSAANTMSKVANTQCSTSASVEQPPVSAPSNVTVQRSASRDELLSPPQDVQTMVVIKKEPPLVPLSQPSPVLNSNSNAHTPEVKKEFIDESSQHSEVSDHSRSDAPIKEELETMENTAEKMMLDKEELKKQKRRMYQQKRRQNQILNKELAQQQPKKRPRKNSKIDEDYDTYIDGVLAQLRQLPPIAVSEPVLNRNFGVVPLFGCGDLAKIGAKDYSTHLGELTGNYGYGELPGFTDFYSTKPYGDMDPLPEKPPSSTQRGFYDQEFPLIRFDADEHKKFDVFCREDSPDSILSSSSPECTREPEGKFVGLKLISDSEEDEEDDAKDAVSKGRMSPVVPVIKPVPIRLKPAGELYFKENLNENKENINSDSLHVMTKSKFDNKQSPPSNVSGHVTVTLTLTSSAAEDIMGVLRDLANILHIPAPTSYQIVERTASPPSQKLGLYRTKGKDGKEGAPIDIQSILNGATKFCKHCDVIILSNIIRRKVSDLPFLAKDSDLLSDGEELFFCSSACYMQFALMHRSPSISEDKAAEIINHLSQKDNLDSKQKLPADALDSSKSIAQKLSFNIKDTKREFEPMETNDAFAFFARTTANKQGNNFYDGAPFKSVPARVHRNDRYKLWTPGCLQPTQKHKTPTDKEIMELLYRMQITVTPPVMPEDTRKCLFCHGIGDGVADGPARLLNFDVDKWVHLNCGLWSDGVYETVNGALMNVENALQSGLLATCVHCQSIGATIKCFKTRCSSIYHLNCAVKDNCVFYKNKTVFCKVHAPKNEKDNELTTLSVSRRVYIERDENKQVAAVMHHSDSTDLLRVGSLIFLSVGQLLPHQLQNFHTPNHIYPIGYKIIRFYWSMRNLNKRCKYICTIREVSGKPEFRVMVQEPPEADVEFSDSTPKGAWQKILDSVATIRKENNCLHMFPKFATGEDLFGLTEPAIVRVLESMPGIETLSDYKFKYGRNPLLELPLAINPSGSARTEPRLRSQLHWKKAHTQRTTGGTSSIRPMFGPSLTGSISTPAQGELACPYSKQFVHSKSSQYKKMKQEWRNNVYLARSKIQGLGLYAARDLEKHTMVIEYIGEIIRSELAECREKQYEARNRGIYMFRLDEERVVDATLCGGLARYINHSCNPNCVAETVEVDRDIRIIIFSKRRILRGEELAYDYKFDIEDDQNKISCMCGAPNCRKWMN

SEQ ID NO: 11905 - protein, 692 aa, Psylliodes chrysocephala
MPKDHRSFRFEYKKKTTESSLSSDSQDYHHKKMRKHSRDRSKEKRLDKTYFDDKRREKPKKSKKKRSKHSSDDSSSSSSESSDNSVKLLEKLTKERIRQTEEKKKEKEVLKATETAEEKRLRRLVKKEAKERRRKEKMGWDNEYLHYTNSDNPFGDGNLLSSFVWNKKLSKEGIKNVSQQDIEARNRLKQEENKRELEKVKKRRLERELERQKREEETQMLQRSKEAAQFEEWERQEDKFHLEQARLRSHIRIQDGRAKPIDLLAKYISAEEEVDAVEMHEPYTYLNGLQIKDLEDLVEDIKVYKELERGKNLDYWNDITVIVEDELQKLRKIEKQNDFDLGLNRREGIHQSVATDVTSVFKGKTAAQLAALEKHIESKISGKADGIDIGYWESLLSQLKAHMARARLRDRHQESLRRKLQVLKAEQAITAPSESQSSDSEEPISEQNEPKPGTSQDAHNSAEDSNEATEDTANIWINECFSAYQAGGYSPKFLTADVIEPGTIIVTEEDDVKRLEFARIQVVGQGAKVENVITKEELLLQKEARKGMDADEAQFSVEQALDSQVYLWSDKYRPRKPRYFNRVHTGFEWNKYNQTHYDMDNPPPKIVQGYKFNIFYPDLIDKSSTPEYYLTPCPENKEFAILRFHAGPPYEDIAFKIVNREWEYSYKRGFRCQFHNNIFQLWFHFKRYRYRR

SEQ ID NO: 11906 - protein, 425 aa, Psylliodes chrysocephala
MDNLEANIMDKSMRSVFVGNIPYEATEEKLKDIFGEVGQVLSFKLVFDRETGKPKGYGFCEYRDQETALSAMRNLNGYEIGGRNLRVDNACTEKSRMEMQNLLNQPPVENPYGEPIQAEKAPEAISKAVASLPPEQMFELMKQMKTTIQNNPTEARQMLLQNPQLAYALLQAQVVMKIIDPHTAATLLHPVNQVPATLMPGDKNVPVQVPINNQYREPPAPVQPPRQEFQPVPPPIMIPNHVQPPVFTGQDVDLRSLGTAPDPRLGPVVRDQDMRQIPGPIQNPLPPTIGESFARDPRGITAFPTDPRQTRMDPRQKNLVPPLTQGPVPTPAPRPVPIVPQPVPVVRPAPVTTTPGPVTPTPAAASPIVGTAGASDQEKAALIMQVLQLSDEQIAMLPPEQRNSILVLKDQIAKSAHSRGSFFFF

SEQ ID NO: 11907 - protein, 392 aa, Psylliodes chrysocephala
MTQIDADREKSLQEYRKKLLEHKEVESRLKEMREQLKDLTKQYDKSENDLKALQSMGQIVGEVLKQLTEEKFIVKATNGPRYVVGCRRQLDKTKLKAGTRVALDMTTLTIMRYLPREVDPLVYNMSHEDPGDVTYSAIGGLSEQIRELREVIELPLMNPELFMRVGITPPKGCLLYGPPGTGKTLLARAVASQLDANFLKVVSSAIVDKYIGESARLIREMFNYAKDHQPCIIFMDEIDAIGGRRFSEGTSADREIQRTLMELLNQMDGFDSLGQVKMIMATNRPDTLDPALLRPGRLDRKIEIPLPNEQARLEILKIHAFPIAKHGEIDYEAIVKLSDTFNGADLRNVCTEAGLFAIRSEREYVIQEDFMKAVRKVADNKKLESKLDYKPV

SEQ ID NO: 11908 - protein, 131 aa, Psylliodes chrysocephala
FGHTFTFRVRPHNPIRSSSRLRDAFIMSRRYDSRTTIFSPEGRLYQVEYALEAISHAGTAIGILAKDGIVLAAERKVTSKLLEQDTSAEKLYVLNDNMICAVAGMTADANILINYARQAAQRYLLTYNEDI

SEQ ID NO: 11909 - protein, 890 aa, Psylliodes chrysocephala
MSETKAEPVKVEVKANGKNDDKNKNELSDEDKQLQEELNLCVEKLLENDTKLYLPALQALANHIRASTTSMTSVPKPLKFMKPHYDTMKQIHEKITDAPVKKVCADIISVLAMTMGEGRDCLKYRLLSDLDKIGEWGHEYVRHLAGEIAGEWAETDFIINTEVRDKLILLTKQIVPYNMAHNAEAEACDLLMEIERLDLLEQYVDENIYSRVCLYLTSCVPYVADPENTTLLQTALMLFRKFKQHPQALRLAMQLNDHSLIEEIFVNCPDTDIQKQLAFMLGRQQIYIEIPESTPEYEDLIEIMANCHLNNHFLNLARELDIMDPKTPEDVYKSHLENSRPPFGGSQVDSARQNLAASFVNGFVNAAFGQDKLLMEDGNKWLYKNKEHGMLSATASLGLVLLWDVDGGLTPIDKYLYSSEDHIKSGALLACGIVNCGVRNECDPALALLSDYVLHNTNIMRIGAIVGLGLAYVGSNREAVLSLLTPVFSDPKSNMEVIGMSALACGMIAVGSGNPQVTTTIMQTLMEKSESELKDTYARFLPLGLGLCHLGKQEGIDTIIAALEVIPEPFKSMATTMVDICAYAGTGNVLKVQHLLHICSEHYDGADSSDKSSKDKDKKEITEKEKDLSSRQAVAVLGIALISMGEDIGSEMAFRTFGHLLRYCEPVIRRAVPLALGLISVSNPKLSILDTLSKFSHDSDAEVAHNAIFAMGLVGAGTNNARLAAMLRQLAQYHAKDPNNLFMVRIAQGLTHLGKGTLTLSPYHSDRQLMSPVAVAGLMATLIGFLDVKNIILGRSHYLLYTLAAAMQPRMLVTFDEDLNPLPVPVRVGLAVDVVGQAGKPKTITGFQTHTTPVLLAYGERAELATEEYIALTPIMEGFVILRKNPDFNT

SEQ ID NO: 11910 - protein, 506 aa, Psylliodes chrysocephala
MTDSKMEPKEEQQPSPEEIKPKVAALETDPQPTQNNGTGVIRRNFITPAGTIIESNEEQPPEPTAEEIVKTSASTPSPVEQKVERTETTTYSEILTQEQREQFPDTKPYAIEMPAENFENQNFAQDISYTTVNIEGNVVPVTLSEIEHPGDYANLQTAQYNNGYADGSQYLAQHQYQNLFINRNDVDNSSPTAVLYRGDPNLADSRYQVNFEVSSTQPQVNILPSSGDSYTYTTPGSWNASSSGSYQQQYPGNINVLHQADSTQSYSAGQYANSTWSSNTMEDGRPSSQEVLVKECVNCGASVTPLWRRDGTGHYLCNACGLYHKINGVHRPPIRPTKKPQATGNRRNGVSCANCKTNNTTLWRRNNQGEPVCNACGLYFKLHNVNRPISMKKEGIQTRKRRPKSSSAGNSGNPGQMRIGLPQYQFQHTQDIEIPQDQYQVPMSVYQQPQPAYRQFATDSHRLNAQPLQPISAEDEQASVITSTSQQARFRTDVEDEDGSNPSMQT

SEQ ID NO: 11911 - protein, 1621 aa, Psylliodes chrysocephala
MALPGNGIFVVKGEISNLLAAMKRGTRWSSHSYQDDDVDALLRNFQELRDILDNVDDLRFVEPNTFLAPFLNVIRSEETTGPVTSLALSAVNKFLSYGLLDPVHASIPQTIHSIADAVTHARFVGTDQSSDGVVLMRILQVLRTLTLSPEGATLTNESLCEIMLSCFRICFETRLADLLRKTAEHYLKDMVQLIFMRLPQFSEDLKVSYIKQLKMKPGALDQTRTKRKKYYPKKESKELETPPPQEIIVQNPAQTGIVDMQGAILQNNDSTTTTNSVNIPSSPTQRDNDITIDIPTDESLKNSETTSSLEDSMEVKPVVEEPKSEESEEQYHQTQDYVNRRGIRFTPQLQQEVNLSPYGLACVRELLRFLISLCNPLDKQNTDIMMHLGLTLLTVAFEISADNIGKYSTLLALVKDDLCRNLFALMNTERLTIFAADLQVSFLLFESLRTHLKYQLEHYLKKLIEIILNDSNKVTYEHKEIALDNLLQLWRIPGFHTELYVNYDCDMYCANLYEELTKLLAKHSISSTSGVYHTHLLSLDALLIIAEGIENRCCEEKGRIESEDNDEITNDISYFIGKSSRIKISENVPKKEELAAKKSIKKWLPQGTEYFNQKPKKGIQFLQEHGVLKHELDVDEVSRFLRENPALNKGMIGEYVSNRSNLKILDAFVKTFSFTGVRIDEALRTFLESFRLPGEAPTISLILEHFAEHWHKSNGEPFADVDSAFTLAYAIIMLNVDQHNENAKKQTVPMTPTAFKKNLKGVNGGNDFEEEMLDEIYTTIKNEEIVMPAEHTGLVRENYLWKILLRKGQTKDGCYIHDNSGTYDSELFQIVYGPIVAALSSVYEKSENESVHKKVMQGFERCAFIAANLNMTKNLDMLILSISKFTIFYNQQKQNTIVVQFGANAKAQLALKSVFSLIHQHGNTMREGWKHLFDLLLALYSNGLLSKTFVEVEDFIEPSGKLNLVYKEAPAAAKQDTGLLSSLYSYMVSAENLSKMPTPEEQNYIEAAKECIKDCNLEQMISDSKFLHEEALFELVKSLIELSRGPDVQESLAYDYNENVTIFFLEVLIKVVIQNRDRVMTIWNNVRDHIYTLVMNASLFDYQFLLERSVIGLLRIAIRLMRNEEMSHIVLQSLRMLLLLKSSTLSRISRQISFGLYELLKTSAQNIHTNTDWTIIFTLLECVGAGAQPPKPVTSAEDTDLKSKSDGETSDHHEEEGALSDSELTKSPKRGVQRPQSPVTVVTSPVGTPNTGGWILVGNEGEIQPVMGRTVPPTQYGLSLEKNLGSHDPRSMMKCCESLAFLVRDVAHITPYNFDVCVHCIRTFVEASLHGTSLRRTRSRKKSSDRHRTRKSPASSPDEDDSDDDDIPSGYHQISIQLLDLMHTLHTRTAQIFKWWAEEGGEISQETSLWTQGWCPLLQGIARLCCDTRRPVRMSAITYLQRALLVHDLQTLSGPEWEQCFQRVLFPLLSYLLQSISPKDAIAMEETRIRAATVLSKVFLHHLTPLLALPSFFNLWLVVLDFMDKYMHADRSELLYEAIPESLKNMLLVMDSARVFDGPDGKNVLWNATWDRIGKFLPTMKDDLFKEIEDQIRKNEEVAVSVDVVVNKDESQMNAEKLIAC

SEQ ID NO: 11912 - protein, 205 aa, Psylliodes chrysocephala
MSILAYNGGAMVAMKGENCVAIAADRRFGIQAQTVATNFEKVFEMGPHLFVGLPGLATDTQTVMEKLRFRKNLYELKENRRISPKVFAAMISNMLYEKRFGPFFVEPVVAGLMPGTFEPYICNMDLIGCINQPTDFVVGGTASAQLYGMCEALWEPNLGPDDLFETISQALMNAFDRDAISGWGATVYIIEKDKVTVKNLKTRMD

SEQ ID NO: 11913 - protein, 935 aa, Psylliodes chrysocephala
MDQKPALDLVISAVSALYNNPNRGEKERASQWLLELQKSVHAWTVADELLHMKRDLESCYFAAQTMRTKIHQSFHELPQEVHTSLRDSLLEHIGQINEATSTAIVTQLCVALADLALQMPSWQKATLDLINRFSQTNIWPLLEILTVLPEELESRSVRLGENRRIEVLEDMKFCAPTVNEFLKHCSNLYGTNWQEHVQVNVKILRCFTSWVSVGAISLNDLANNVVINRAFEILNFKPQNDKHTISGAFHEAATDCICTLLLCLEDNNNQLGLESYLFNNIINLDVPYHLSVANEDQGKSMDYCRLFTELAESFLEKIINNSNTEQMHYATKILDFVLMCVGHHDYEVAEITFNLWYVLSEELYQKNNKELTELFRPYVERLVTALCRHCQMEPDSEGLLEEGDEFRDFRLKVSDLIKDVVFIVGSSSCFRQMFMSLQAPGVTWDSSEAALFIMQAVAKNVLPSENEVVPKVVEAILNVPENTHVAVKYTSVLLLGELCEWIEKHPNTLDPILNFLVCCLPQHGVGAASAVALQNICASCSEHMPRHVPILLQLLHQSETFAISNTATIGLLKGVASIIGRMPHGDMTAALRELCSMQLNPICQLIEQDVTPLKGSKTDPVTWLDRLSSVLRYINVNVHEGELNPCKPVILEVWPVLSRVFDKYQSDIRIMERCCRAVRFMLRCVSQQVRELLDSLVGQIVRIYSLYKHSCFLYVGSILVDEYATDAHCVQGLLDMLQAFLEPTFHLLQEENGLRNHPDTVDDFFRLCARFMQRAPVAFLKCASLVHILQCALLASTLDHKEANMSVMKFFYDLVNQGQSGRADPDYETRKMLVRSILDEYGQQLVSNLIHSCVFYLHSYMLSEVGDVFVQLLDFDRESTSKWLAAGIECLPKHSNGGIVAATPQQLTDIHIAITRSNTSKSVTHALKDLTRLYR

SEQ ID NO: 11914 - protein, 502 aa, Psylliodes chrysocephala
MAQRFPVPVVNQGPGGPPPPQRYQQQPPNQGMRQYGQQNFPPRPGYNPPPPNMQSSGGTMIQRPPGTPYSPMRGGPMPPQQGSKRPTDNRNPLQQKTNEYPHGTSKKKKKLADKILPQKVRDLVPESQAYMDLLAFERKLDSTIMRKRLDIQEALKRPMKQKRKLRIFISNTFYPAKEPQPEGPEGPCQEGSVASWELRVEGRLLEDSKNDPNKVKRKFSSFFKSLVIELDKELYGPDNHLVEWHRTLTTQETDGFQVKRPGDKNVRCTILLLLDYQPLQFKLDPRLARLLGVHTQTRPVIISALWQYIKTHRLQDSHEREYIVCDKYLEQIFNCTRMKFAEIPQRLNPLLHPPDPIVINHVISVEGGAESKQTACYDIDVEVDDTLKTQMNNFLLSTASQQEIQGLDAKIHETVDTINQLKTNREFFLSFAKDPQQFIHKWIVSQTRDLKTMTDVVGNPEEERRSDFFYQPWAQEAVCRYFYTKVQQKRAELEQALGIRNN

SEQ ID NO: 11915 - protein, 144 aa, Psylliodes chrysocephala
MPKVRRSKKPPPEGWELIEPTLDELEQKMREAETESHEGKRKNESLWPIFKIHHQKSRYIFDLFYRRKAISRELYEYCLVENIADKNLIAKWKKQGYESLCCLRCIQTRDTNFGTNCICRVPKAKLEEGRIVECVHCGCRGCSG

SEQ ID NO: 11916 - protein, 294 aa, Psylliodes chrysocephala
MPAATLGSISHPNNEDCGIRDVWAHNLEDEFRTIRQIVQKYQYVAMDTEFPGVVARPIGEFRSSADYQYQMLRCNVDLLRIIQLGLTFLDDNGKTPGGAYTTWQFNFKFNLQEDMYAQDSIDLLQNSGIQFKKHEDEGIEPLEFAELLMSSGIVLMENIKWLSFHSGYDFGYLIKLLTDNNLPQDETEFFDLLKLYFPTIYDVKYLMKSCKNLKGGLQEVAEQLELERIGPQHQAGSDSLLTGMAFFKMKEMFFEDTIDDSKFSGHLYGLGTSFTVNGTTNNYANDNGDTTNSS

SEQ ID NO: 11917 - protein, 403 aa, Psylliodes chrysocephala
MEAAQKRGASVFEDLSNVEFETSEDVEVIEKFKNMNLKEELLRGIFAYGFEKPSAIQQRAIKPIMKGRDVIAQAQSGTGKTATFSISILQALDLTMRETQVLCLSPTRELAVQIQKVILALGDFMNVQCHACIGGTNLGEDIRKLDYGQHVVSGTPGRVYDMIRRRALRTRSVKMLVLDEADEMLNKGFKEQIYDVYRFLPPSTQVVLISATLPHEILEITSKFMTDPIRILVKRDELTLEGIKQFFVAVEREEWKFDTLCDLYDTLTITQAVIFCNTKRKVDWLTEKMRENNFTVSSMHGDMPQKERDNIMKEFRSGQSRVLITTDVWARGIDVQQVSLVINYDLPNNRELYIHRIGRSGRFGRKGVAINFVKSDDIRILRDIEQYYSTQIDEMPMNVADLI

SEQ ID NO: 11918 - protein, 560 aa, Psylliodes chrysocephala
MTAPAAGGDARGRTLAYKDKSKPADVRTSNINAAKAVCDAIRTSLGPRGMDKMIQAGNGEVTITNDGATILKQINVIHPAAKMLVELSRAQDIEAGDGTTSVVVIAGALLDAAEKLLHRGIHPTAISESFQRAALLAVEILNGISTPIEITNRELLIKSASTSLNSKVVSQHSSLLGPLAVDAVLKIVEPGHEEACNLEDIKVIKQLGGTVEDTELVEGIVFSQRSANVSGPKRIEKAKIGLIQFCISPPKTDMDHNVIISDYAAMDRVLKEERAYILNIVKQIKKAGCNVLLVQKSILRDAVSDLALHFLDKIKCMVVKDIEREDIEFVCKSLGCRPIASLDHFTTENLVGADLVEEVGVGGNRMVKITGAQNAGRTVTLLVRGSNKLVLEEAERSLHDALCVIRCLVRKKALIAGGGAPEIEVALKLAALANKLDGIDAICTRAYANALEIIPFTLAENAGLNPIQTVTELRNRHAKGETSAGINVRKGAITDILEENVVQPLFVSTSALSFATETVRSILKIDDIVSIYIKFNFSLDLRKTKRQYRNGNVALYHKYS

SEQ ID NO: 11919 - protein, 409 aa, Psylliodes chrysocephala
MEAMDIVIPEKEEGSPSEAKQALQDLDTEDLYTKYKKLQQMLEFLEVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVQYCDIGGMDMQKQEIREAVELPLTHFELYKQIGIDPPRGVLMYGPPGCGKTMLAKAVAHHTTAAFIRVVGSEFVQKYLGEGPRMVRDVFRLAKENSPAIIFIDEIDAIATKRFDAQTGADREVQRILLELLNQMDGFDQTTNVKVIMATNRADTLDPALLRPGRLDRKIEFPLPDRRQKRLIFSTITSKMNLSEEVDLEDYVARPDRISGADINAICQEAGMHAVRENRYIVLPKDFEKGYKNNIKKDESEHEFYK

SEQ ID NO: 11920 - protein, 205 aa, Psylliodes chrysocephala
LFCKQSHIASASANDRRARPSHSSYPISDYYSSHKMADAKPMSKIWLISNDSATIEVDRAVVERSMLIKNMLEDVGDDTISQTNPIPIPNVNEAVLRKVIEWCNHHRDDPAQAADDESDARKKTTDIDEWDQKFMQVDQEMLFEIILASNYLDIKPLLDVGCKTVANMIKGKSPEEIRKTFNITNDFTPEEEEQIRRENEWAEDR

SEQ ID NO: 11921 - protein, 309 aa, Psylliodes chrysocephala; identical to SEQ ID NO: 11464

SEQ ID NO: 11922 - protein, 685 aa, Psylliodes chrysocephala
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEASDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEASDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGQ

SEQ ID NO: 11923 - protein, 540 aa, Psylliodes chrysocephala
MMQPQILLLKEGTDSSQGKPQLISNINACQNVVDAIRTTLGPRGMDKLIVGSGGAATISNDGATILKLLDIIHPAAKTLVDIAKSQDAEVGDGTTSVVLLAGEFLRQIKPYVEEGVHPRIIIKAVRKATQICLEKISSLAVKINKSNADEFRSLLEKCAATAMSSKLINQQRSFFSKMVVDAVLLLDELLPLNMIGIKKVQGGGLEESVLVAGVAFKKTFSYAGFEMQPKIYKDCKIALLNIELELKAERDNAEIRLTSVKEYQKVVDAEWNILYNKLQKIHESGANAVLSKLPIGDVATQYFADRDMFCAGRVGEDDMKRTLKACGGAVMTTVNDLNDSVLGKCQLFEEKQIGGERYNFFKGCPNAKTCTLLLRGGSEQFLEETERSLHDAIMIVRRTIKNDSVVAGGGAIEMELSKLLRDHSRTIAGKEQLLIGAIAKALEIIPRQLCDNAGFDATNILNKLRQKHAQNNPWYGVDIAKEDIIDNFEACVWEPAIVKVNALTAAAEATCLILSVDETIKNQKSEAPPQMGGRGMGRPM

SEQ ID NO: 11924 - protein, 4060 aa, Psylliodes chrysocephala
MFRIFSRFNALFVRPHIRGAIREYQTHLIQRVKDDIEALHEKFKVQYPQSNSAKISKVRDLPPVAGSIVWAKQIDHQLTTYLRRVEDVLGKGWENHIEGQKLKADGDSFRLKLNTQEIFDDWARNVQQRNLGVSGRIFTIEAVRSRSGRGNILKLKVNFLPEIITLAKEVRNLKCLGFRVPLAIVNKAHQANQLYPFAISLIESVRTYEMTLEKIEDKASIIPLVAGMRKEVQQVIAEGIQLVWESYKLDPYVQRLSDLVVSFQERVEELVFVGEQLEVDVRSLETCPYSANTFADILSKIQHAVDDLSLKQYSNLHIWVSRLDEEVEKNLARRLQAGVEAWTETLSGQKKEIDHSMDTDAPAQPTHKPGGDPQIQTMIHEVRITNQTMYLYPSIEEARFLIMQQLFAWQAIVTSQQRLQSSRYQVGVDKPVTETYRNILTKLPAGPQPLTNAYSAISSKIKEVQSYVNEWLTYQSLWDLQADNLYGKLGEDISKWMECLNDIKKTRTTFDTSDTRREFGPIIIDFAKVQSKVSLKYDSWHKDTLGKFGSLLSNEMTSFHSNVSKSRSDLELQSIEAASTSDAVCFITYVQQLKRSMKAWEKQVDIYKEGQRILERQRFQFPTNWLHVENLEGEWGAFNEIIKRKDSSIQTQVASLQQKIVSEDKAVESRTNDFLVDWERSKPVEGHLRPDDALSQLQLFESKFSRLKEERDNVAKAKEALELQDPGGISTSEDRMQVVYEELQDLRGVWSELSRIWQQIDETREKPWLSIQPRKLRQQLDQLSTQLKELPARLRQYASYEYVKKTLQTYTKVNMLIVELKSDALKERHWKQLMKQLRVNWVLSDLTLGQVWDVNLQKNEAIVKDIILVAQGEMALEEFLKQVRESWQNYELDLINYQNKCKLIRGWDDLFNKVKEHINSVAAMKLSPYYKVFEEEALTWEEKLNRINALFDVWIDVQRRWVYLEGIFSGSADIKTLLPVETSRFQSISSEFLGLMKKVSKSPMVMDVLNIPGVQRALERLADLLGKIQKALGEYLERERTSFPRFYFVGDEDLLEIIGNSKNVARLQKHFKKMFAGVASILLNDNNTIITGIASREGEEVVFNSPVSTVDHPKINEWLSMVEKEMRVTLASNLTQAVQDIKQFKDEIDSKAYMEWVDKYQAQIVVLAAQILWSEDVEAALVKMNSEPQKGVLEKVLQQVESTLNVLADSVLQEQPQLRRKKLEHLINEFVHKRTVTRRLIANGVCSNKAFEWLCEMRFYFDPRQTEVLKQLTIHMANARFYYGFEYLGVQDRLVQTPLTDRCYLTMTQALEARLGGSPFGPAGTGKTESVKALGNQLGRFVLVFNCDETFDFQAMGRIFVGLCQVGAWGCFDEFNRLEERMLSAVSQQIQTIQEALKSQKEAAAEGTATGSISVELVGKQVKVSPDMAIFITMNPGYAGRSNLPDNLKKLFRSLAMTTPDRQLIAEVMLFSQGFRQAEKLASKIVPFFRLCDEQLSNQSHYDFGLRALKSVLISAGNVKRDRIQRIKEGMTQRGETNIDEANIAENLPEQEILIQSVCETMVPKLVAEDIPLLFSLLNDVFPNVQYTRAEMQGLKDEIRKVCAEEYLVCGEGDERGSAWMEKVLQLYQISNLNHGLMMVGPSGSGKSSAWRVLLKALERFEGTEGVAHVIDPKAISKEALYGVLDPNTREWTDGLFTHILRKIIDNVRGEINKRQWIIFDGDVDPEWVENLNSVLDDNKLLTLPNGERLSLPPNVRVMFEVQDLKYATLATVSRCGMVWFSEDVLSTEMIFENYVLRLKNIPLEESEEGFGKKSDMKEDMLSPTLQLQLDVVNLLQPFLAPDGLVVRCLEYAMEQEHIMDFTRLRALSSLFSMLNQAVRNVLQYNHMHPDFPLSNDYLEKYIPKCLIYSILWSFAGDAKLKVRSELGDFTRSVSTIPLPPDNSMPIIDYEVTIEGEWSLWSNKVPQIEVETHKVASPDIVVPTLDTVRHESLLYTWLAEHKPIVLCGPPGSGKTMTLFSALRALPDMEVVGLNFSSATTPELLLKTFDHYCEYRKTPNGVVLSPIQLGKWLVLFCDEINLPDMDTYGTQRVIMFLRQIVEQKGFYRASDQSWVSLERIQFVGACNPPTDPGRKPLSHRFLRHVPVIYVDYPGETSLKQIYGTFTRAMLRLAPGLKGYANPLTNAMVEFYLASQDRFTQDMQPHYVYSPREMTRWVRGICEAIRPLDNLSVEGLVRLWAHEALRLFQDRLVEDTERRWTNENIDAVALKHFPSANCERALERPILYSNWLSKDYVPVGREQLREYVKARLKVFYEEELDVPLVLFDEVLDHVLRIDRIFRQPQGHLLLIGVSGAGKTTLSRFVAWMNGLSIFQIKVHNKYTAEDFDEDLRSVLRRSGCKHEKISFILDESNMLDSSFLERMNTLLANGEVPGLFEGDEYTTLMTQCKEGAQREGLMLDSNDELYKWFTQQVMRNLHVVFTMNPSTDGLKDRAATSPALFNRCVLNWFGDWSDGALFQVGKEFTNRLDLDKQSWRCPDFFPAACNHVSASPNHREAVINACVYVHQTLHKANSRLVKRGSRTMAITPRHYLDFIHHLVKLYNEKRSDLEEQQLHLNVGLNKIAETVEQVEEMQKSLAVKSQELQAKNEAANAKLRQMVKDQQEAEKKKVQSQEIQQQLAQQTVHIQQKRSEVMADLEQVEPAVIEAQQAVKSIKKQQLVEIRTMSNPPALVKLALESICLLLGENASDWKSIRAVIMRDNFINSIVNFNTEDISDEVREKMKSRYLSNPDYNIDKIYHASNACGPLVKWACAQVQYADMLKKVEPLREELRSLEQQAETNQKRGEDVKALISQLEQSIASYKEEYAQLIAQAQAIKTDLENVQAKVDRSIALLKSLVIERERWEASSETFRSQMSTIIGDVLLSAAFIAYGGYFDQHYRQNLFSTWCQHLTQASIQYRADIARTEYLSNPDERLRWQANALPSDDLCTENAIMLKRFNRYPLIIDPSGQATEFIMNEFKDKKITKTSFLDDSFRKNLESALRFGNPLLVQDVENYDAILNPVLNRELRRTGGRVLITLGDQDIDLSPSFVIFLSTRDPTVEFPPDICSRVTFVNFTVTRSSLQSQCLNQVLKAERPDIDAKRSDLLKLQGEFHLRLRQLEKSLLQALNDAKGKILDDDSVITTLETLKQEAAEIGQKVEETDKVISEIETVSQQYLPLSQACSNTYFTMDSLNQIHFLYQYSLKMFLDVFASVLHNNSKLDGISDYQARLNVITSNLFSVVYERVARGMLHNDRMTFAILLCRIHLKGQLSEPNLDQEFNFFLRGKEGVFNSSGSTIVDGLNSDQQEAITRLSTKLPTFRKLPNDQQEAITRLSTKLPTFRKLPNEIKEMPEFGAWLQQSSPEQAVPQLWIEEKQLSAIGRGMYQLLVIQAFRPDRVIAAAQSFVAAVLGPDFMYLAEKELDFATCIEKEIRSNVPALLCSVPGFDASGRVDDLAAELNKQISSIAIGSAEGFNQADRAINMACKTGRWVMLKNVHLAPQWLVQLEKKLHSLQPHANFRLFLTMEINPKLPVNLLRAGRIFVFEPPPGIRANLLRTFSTVPASRMMKAPNERARLYFLLAWFHAIVQERLRYCPLGWAKYYEFSESDLRVACDTLDTWIDTTAMGRTNLPPEKVPWDALVTLLSQSIYGGKIDNDFDQRLLHSFLNKLFTPKSFESDFALVANIDNGPGGNRHITMPDGTRRDHFLKWIESLADRQTPAWLGLPNNAEKVLLTTRGTDLIAKLLKMQQLEDDDELAYSIDDSSPTDPAQVDGRPSWMKTLHNSGATWVNLLPTSLQTLRRTVENIKDPLYRYFEREVNSASKLLTDVLHDLNDVLLICQGDKKQTNYHRTMLSELVRGIIPKNWHRYTIPKGCTVMQWITDFSQRIKQLQKVSKVVSSAGAKELQSFPVWLGGLLNPEAYITATRQCVAQANSWPLEELHLDVTITDSNDKDSVPHDCFAVVGIKLQGAQCRNNQLLLTSSIMIELPITLFRWVRIIGEDKLKEGKLSLPLYLNSTRTELL

SEQ ID NO: 11925 - protein, 890 aa, Psylliodes chrysocephala
MSNHRSKKQIESDSDSDSVDSAEEARRRDLKERDEFATRLKKRDEERTRNIVQSSDKKAYEEAAKRLKLDNAEKEKLIPELRKISRRKYLEKRKDDKLQELEADIADDEYLFEEKVLTEREKKERQHKKELLQLAQEHEKARELERIQRYHMPRDLGKDSTADYIEVDELEKVPQSEQKKWEKDQMASAVFKFGAKDVKKKDDYELLLEDQIDFIQALQMPGVIEKKEKELTEVEKKKLSIEETKKSLPIFPFKDDLIQAIREHQVLIIEGETGSGKTTQIPQYLHEAGFTEDGKKIGCTQPRRVAAMSVASRVAQEMGVKLGNEVGYAIRFEDCTSERTVIKYMTDGTLHREFLSEPDLQSYSVMIIDEAHERTLHTDILFGLVKDIARFRPELKLLISSATLDVTKFSEFFDDAPVYQIPGRRFPVDIYYTKAPEADYVDACVVSVLQIHVTQPLGDILVFLTGQDEIETCHELLQDRVRRLGSKVKELLILPLYANLPSDMQAKIFEPTPPGARKVVLATNIAETSLTIDNIIYVIDPGFAKQNHFNSRTGMESLMIVPISKASANQRAGRAGRVAAGKCFRLYTAWSYKHELEDNTVPEIQRINLGNAVLMLKALGINDLVHFDFLDPPPHETLVLALEQLYALGALNHHGELTKLGRRMAELPVDPMMAKMVLASEKYKCAEEIVSIGAMLSVNGAIFYRPKDKIIHADTARKNFNHSGGDHLSLLNVYNQWRDSDYSLQWCYENFIQYRSMKRARDVREQLVNLMARVEIEMLSSIEDIDNVRKAITAGYFYHIARFSKGGSYKTVKHNQSVTIHPNSSLFESLPRWVLYHELVFTTKEFMRQVIEIESKWLLEVAPHYYKSKELEDTTNRKMPKTIGRSKMTD

SEQ ID NO: 11926 - protein, 456 aa, Psylliodes chrysocephala
MKVEEVKSTVKTQRISAHSHIKGLGLDDAGFAIQSAAGLVGQEQAREAAGVVVDMIKSKKMAGRAVLLAGPPGTGKTAIALAIAQELGNKVPFCPMVGSEVYSSEIKKTEVLMENFRRAIGLRIRETKEVYEGEVSELTPVETENPAGGYGKTVSHVVIGLRTAKGSKQLKLDPSIYEALQKEKVEVGDVIYIEATSGAVKRQGRSDAYATEFDLEAEEYVPLPKGDVHKKKEVVQDVTLHDLDAANAKPQGGQDVLSMMGQLLKPKKTEITDKLRKEINKIVDKYIDQGIAELVPGVLFIDEVHMLDLETFTYLHRALESAIAPIVIFATNRGRCLIRGTDDIFSSHGIPLDLLDRLLIIRTIPYGRSDMEQILKLRATTEGLEIESDAIAILGEIGTKATLRYAVQLLTPSHLTAKINGRHNIIQSDIEEVGSLFLDAKSSAKILTDNKEKFMT

SEQ ID NO: 11927 - protein, 731 aa, Psylliodes chrysocephala
MTSIIKLQVLSGAKDESPPCYLLQVDDVRILLDCGWDEKFDMEFIKEIKRHIHTIDAVLISYPDNYHLGALPYVVGKLGLNCPIYSTIPVYKMGQMFMYDLYQSQYNMKEFCIFSLDDVDVTFEKFIQLKYNQTMPLKGKGYGLTVTPLPAGHMIGGTIWKIQKVGEEDIVYCNDFNHKKERHLNGCELEKLQRPSLLITDAFNASYQQARRRARDEKLMTNILQTLRNHGNVLIAVDTAGRVLELAHMLDQLWRNKESGLLAYSLAFLNNVSYNVVEFAKSQIEWMSDKLMRSFEGARNNPFQFKHLQLCHSLVELNKVPSPKVVLASSPDLESGFSRELFLQWCSNHNNSIILTTRTSPGTLARDLIDNGGGRNIDLTVERRVRLEGQELDDYERRQRSRSDKIDNEDADSDSDSDIEMSVISKGKHDIVIKQEGKISTGFFKVTKKMYPMYPFHEEKIKCDEYGEIVKPEDYKLAEVIPEGEDNKENIVIKKEEEEITEITEQPTKCIVLQRTVQVNCQVQYIDFEGRSDGESLMKILTQLKPRRVIVVRGTEENTAVIEKHCLENMQGRVFTPSRGEIVDATSETHIYQVRLTDALVSQLSFQKAKEAEVAWLSAHIMLRESQADARRINVDDEEMEVVDEETRILTLEPLPEGSPHDPVFINELKLAEFKQVLGRNSINSEFSGGTLWCCNGTIAVRKVENGKMMLEGIVLIRNFLGVLCGAVMVL

SEQ ID NO: 11928 - protein, 761 aa, Psylliodes chrysocephala
MPPLEVTSNTNNEEPGPINPVVGIIYPPPEVRNIVDKTASFVARNGPEFEARIRQNELGNPKFNFLNGGDPYHAYYQHKVKDFREGKGQEPSPGLSLAVSKLSVSASAQQKQQEILKQVEQPFVPKDPPQDFEFIADPPSISALDLDIVKLTAQFVARNGRAFLTQLMNREQRNFQFDFLRPQHSLFQYFTKLLEQYTKVLIPPKSMQQRLRDEAKSAKAVLEQVKYRAEWLRYQEQQKAKEEEILERERVAYAQIDWHDFVVVETVDYQPFEIGNFPPPTTPEEVGARILIQERIEDGEDIEMQLESDDDDDTPNAEEGLSTMQDKTKRKGGDDNRVQDMEEESSDEDENEGKTPRAPPPPSIQPPLPPAPDKVLVKKYDPKQAVKVARPTVGDDYLVSPITGEKIPASKVQEHMRIGLLDPRWVEQRDKQITDKMNQDTVYAAGSAIDASLKLLAERRTDIFGVGDEETAIGKKIGEEDVRKDEKVTWDGHTSSVEAATRAARANITLEEQIHQIHKVKGLLPDEEKEKIGPKNIGSKKINIQSIITTKPPNPPVQPPKPPVSLIQTPAPQMIPVPTQAAMMAPQPPIMMMPAPPMPPIRPPPLMMPGPPPMGGFPVGPMPGPPMGPGMNMPPMKHPNDGPSEDEPSNKKLRNEDSLIPENVFLSRNPSQVSIKVSIPHMPEKSEWRLTGQMMSWTFPLGESVANLKAKLQEETNMPPAKQKLFFDGMFFKDSNTLAYYNVTPGAVIQLQIKERGGRKK

SEQ ID NO: 11929 - protein, 332 aa, Psylliodes chrysocephala
MPSSDVTTTKVIVHPLVLLSVVDHFNRMGKIGNQKRVVGVLLGCWRAKGVLDVSNSFAVPFDEDDKDQSVWFLDHDYLENMYGMFKKVNARERVVGWYHTGPKLHQNDIAINELVRRYCPNSVLVIIDAKPKDLGLPTEAYQAVEEVHDDGSPTSKTFEHVPSEIGAEEAEEVGVEHLLRDIKDTTVGTLSQRITNQLLGLKGLHSQLKDIRDYLLNVCDNTLPINHQIIYQLQDIFNLLPDINQDAFNNSFYVKNNDQMLVVYLAALVRSIVALHNLINNKLTNKDAEEGKKEEKKDSKDKDKDSKDKDSKDKDKEKGEKDKDAKKDEKKK

SEQ ID NO: 11930 - protein, 550 aa, Psylliodes chrysocephala
MFGGGRAPILVLSQNTKRESGRKVQVENINAGKQIADVIRTCLGPQAMLKMLMDPMGGIVMTNDGNAILREITVQHPAAKSMIEIARTQDEEVGDGTTSVIVLAGEMLAAAEQFLEQQIHPTVIIRQYRQALEDMVLFLEGPLSVPVDRNDKKALAQVVKGCVGTKFLCRWSDLAVGIALDAVSTVLLEENGRTEVDIKRYAKVEKIPGGSVEESKILKGVMLNKDVTHPKMKRVVKNPRIILLDCALEYKKGESQTNVEISAETDFTKLLELEEEHVKRQCDEIIAFKPDVVFTEKGVSDLAQHFLLKAGISAVRRVRKSDNNRIARACGGTIVNRTEELQETDVGTGAGLFEIKKIGDEYFCFVDECKNPKACTILLRGASKDILNEIERNLQDALQVARNIVLSPRLVPGGGAIEMAIAQRLMQKATHGPYRALAHALEIIPRTLAQNCGANTIRTLTALRAKHANHTDAEKPCTWGIDGETGEIVDMETKGLWEPLSVKLQTYKTAIETAILLLRIDGIVSGSKKKGDKEPPTPSQVQQQDAREAD

SEQ ID NO: 11931 - protein, 234 aa, Psylliodes chrysocephala
MMMQTEMNAYYPDYSTAPIQRQINPYADNGGSVVAIAGNDFVVVGADTRLSSGFSIYTRNQNKLFPMSDTTVLGCAGCWCDTLTLTRILKSRMQMYQQEHNKQMSTTACAQMLSTMLYYKRFFPYYISNILVGLDNEGKGCVYSYDPIGHCEKATYRAGGSAGALLQPLLDNQIGQKNLVKPSSEDLSQEKALAILKDVFIAAAERDIYTGDSVLINIITKDGTKVETFELRKD

SEQ ID NO: 11932 - protein, 291 aa, Psylliodes chrysocephala
MFPEIPRPFNMTYKCYSVAMFPGNERQDVERGGKIIMPPSALEQLTRLNINYPMLFKLVNKKTNRTTHCGVLEFVADEGKVYLPLWMMHNLVLSEGDLVQMESISLPVGTFSKFQPLNPDFLDITNPKAVLENCLRSYACLTTGDVIAVKYNQKAYELCVLETKPGNAISIIECDMNVEFAAPVGYKEPERFKKEEEEMSIDPADLMPEPSGFVAFRGAGNRLDGKKRKDSSSSDSHVSKPTYVKGIPDYDYEIGTLNFIRRTLKTKEKENDDNEEFKAFSGTGFSLRARQ

SEQ ID NO: 11933 - protein, 540 aa, Psylliodes chrysocephala
MSTFPGSIAFDEYGRPFIILRDQDRQKRLTGIDALKSHILAASQIAHTVSTSLGPKGLDKMMVSPDGEVTVTNDGATILKMMDVEHQVAKLLVQLSQSQDDEIGDGTTGVVVLAGALLEQAGTLLDRGIHPIRIADGFELACQTAVEHLEKIAEVFPVSAENTEPLVKVAMTTLGSKIINKCHRQMAEIAVNAVLAVADLEQKDVNFELIKVEGKVGGKLEDTTMVRGVVIDKTMSHPQMPKELRNVKLAILTCPFEPPKPKTKHKLDVASVEDYKELRQYEQDKFKEIVSLVKNAGATLAICQWGFDDEANHLLLQQELPAVRWVGGPEIELIAIATGGRIVPRFEELSPEKLGYAGLVREISFGTTKDKMMVIEECKNSRAVTILVRGGNQMLVAEAKRSLHDALCVVRSLVQEPRVVYGGGAAEIACSLAVAAQADQLATLEQYAYRGFAEALESIPLALADNSGLSAIHTLGEIKAKQSATGDPALGVDCMNTGNINMREQHVTESVKSKRQQLLLATQLVKMILKIDDVRQPGSG

SEQ ID NO: 11934 - protein, 113 aa, Psylliodes chrysocephala; identical to SEQ ID NO: 11364

SEQ ID NO: 11935 - protein, 534 aa, Psylliodes chrysocephala
MVSLNPVRILKQEAEEERAEIARLSSFVGAIAIGDLVRSTLGPKGMDKILVSSGRSAGHVEVTNDGATILKSVGVDNPAAKILVDMSKVQDDEVGDGTTSVTVLASELLKEAERLVEQKIHPQTIIAGWRKAVDAARKALLDASKDNSANLEAFKEDLMNIARTTLSSKILSQHKEHFAKLTVDAVLRLKGSAELQSIQLIKKTGGTLQDSFLDEGFLLDKRPGVHQPKRVENARILIANTPMDTDKIKVFGSHIKVDSMAKVAELESAEKDKMKDKVNKILKHNANVFINRQLIYNYPEQLFADAGVMAIEHADFDGIERLALVTGGEIVSTFDHPELVKLGTCNLIEQIMIGEDTLLRFSGVALGEACTIVIRGATRQIIEEADRSIHDALCVLAATVKESRIVYGGGCSETLMATAVTKAAANTPGKEAVAMEAFARALLQLPTIIADNAGYDSAQLISELKAAHNSGLNTMGLNMDKGEVGDMKTLGITESFVVKRQVLVSAAEAAEMILRVDDIIKAAPRRRTEDRGMC

SEQ ID NO: 11936 - protein, 280 aa, Psylliodes chrysocephala
MFRNQYDSDVTVWSPQGRLHQVEYAMEAVNLGSATVGLKSDNYAVIIALKRASSELSAYQKKIINIDDHIGITISGLTADARILSRYMRNECLNYKYSLDAYMPLNRLISILGNKMQHCTQRYDRRPFGVGLLVAGFDDTGAHIYQTCPSANFYNCKAMSIGARSQSARTYLEKKLDELSSASLEELIKHGLRALRDTLPPEVDLTTKNVSIGYVGKGQNFKILEEEETAPYLSLIEGEERRGGGGGGIADAPADPLREGEAGDDGPRDPIPAVAMDTTE

SEQ ID NO: 11937 - protein, 855 aa, Psylliodes chrysocephala
MGLKPGDESEPMEITFNDDDLPYEEEILRNPYSVKHWLRYIDHKKSAPNNGVNIIFERALKQLPGSYKLWYNYLRTRRNQIKSKCITDPGYEEVNNAFERSLVFMHKMPRIWMDYCTFLTDQCKITRTRKVFDRALRALPVTQHNRIWPLYLKFVQKHDIQETAVRVFRRYMKLCPENAEEYIDYLSNIERLDEAAMLMAKIVNDENFVSQQGKSKHQLWNELCELISKNPEKVHSLNVDAIIRGGLRRYTDQLGHLWNSLANYYVRSGLFERARDIYEEAIQTVTTVRDFTQVFDAYAQFEELSLSKRMEEVATKQNPSEDDDTELELRLARFEYLMERRLLLLNSVLLRQNPHNVQEWHKRVQLYEGKPHEIINTYTEAVQTVEPKLAVGKLHTLWVDFAKFYETNGQIEEARLIFEKASQVSYVKVDDLATVWCEWTEMEIRNENYDEALRLMQRATVMPSRKVAYHDDSETVQSRLYKSLKVWSMYADLEESFGTFKSCKAIYDRIIELKIATPQIIINYGVFLEENNYFEEAFRAYEKGISLFKWPNVYDIWNTYLTKFLKRYGGTKLERARDLFEQCLDGCPPQFAKHLYLLYAKLEEEHGMARHAMAVYERSTTAVPENEMFDIFNIYIKRAAEIYGIPKTRQIYEKAIEVLPEDKTREMCLRFADMETKLGEIDRARAIYAHCSQICDPRITAEFWQIWKEFEVRHGNEDTMREMLRIKRSVQAVYNTQVNMMSAQMLSSAGSMSGTIADLAPGVKDGMRLLEAKAAEMAGIPQSSTKPGNIMFVRGETQGANKDRVVNPDEIDIGSDDDDDEEEEDDIQVEKQNVPSEVFGSLKKNQQGNDEDDED

SEQ ID NO: 11938 - protein, 385 aa, Psylliodes chrysocephala
MANGPIAERNRDATIYVGGLDDKVSESLLWELFVQAGPLVNVHMPKDRVTMMHQGYGFVEFMGEEDADYAIKIMNMIKLYGKPIRVNKASAHQKNLDVGANIFIGNLDPEVDEKLLYDTFSAFGVILQTPKIMRDPETGNSKGFAFINFASFEASDASIEAMNGQYLCNRPISVSYAFKKDSKGERHGSAAERLLAAQNPLSQADRPHQLFADAPPIGMMPMTIAPPPPPLITGMMPPPPPTPGGMPPPPPPVPPPNSFPSGIPPPPLPPSQPPLPPGAPPNLAATGGSGPRPPMPGGMPRMPPPPPWTGGPSGNVPMPPGPPTSAASGGFGGMFPPPPPPGGRPPPPNWRPPPPPPPGFGGVRPPFPPRGPPPPPFPPRGPPPP

SEQ ID NO: 11939 - protein, 257 aa, Psylliodes chrysocephala
MGRVIRAQRKGAGSVFKSHTKRRKGAPKLRYLDFSERHGYIKGVVKDILHDPGRGAPLAVVHFRDPYKFQTRKELFIAPEGMYTGQFLYCGKKANLQIGNVLPVGTMPEGTIVCNLEEKTGDRGRLARASGNYATVIAHNHDTRKTRVKLPSGAKKVIPSNNRAMVGIVAGGGRIDKPILKAGRAYHKYKVKRNCWPKVRGVAMNPVEHPHGGGNHQHIGKASTVKRGTSAGRKVGLIAARRTGRIRGGKVDAKKED

SEQ ID NO: 11940 - protein, 136 aa, Psylliodes chrysocephala [sequence omitted]

SEQ ID NO: 11941 - protein, 533 aa, Psylliodes chrysocephala
MAISLLNPKAEVARAAQALAVNITAAKGISDVMKSNLGPKGTMKMLVSGAGDIKITKDGNVLLHEMQIQHPTASLIARASTAQDDMTGDGTTSTVLVIGELLKQADIYIAEGLHPRILTEGFDKARVKALEVLEKIKIPVEINKEILTDVCKTSLRTKLHQNLADLLTDVCVDAVLAIRQPDKPVDLHMIELMEMQHKTETDTQLVKGLVLDHGSRHPDMPKSLKNCYILTCNVSMEYEKSEVNSGFFYKTAEEREKLVSAEREFIEQRVKKVVELKKSLCNGTDKTFVVINQKGIDPMSLDMLAKEGIIALRRAKRRNMGRLALACGGIAMNSFDDLQESHLGRAGHVYEHVLGENNYTFVEDCKVPQSVTILMKGPNKHTLLQIKDAVRDGLSAINNTIEDKAVIPGGGAFEVTANKELLAYKDEIKGKARLGVAAYAEALLVIPKTLAVNSGFDAQDTIVKLQEEARLNPEPIGLDLTSGEPINPKDSGIYDNYVVKKQIMNSCSIIASNLLLVDEIMRAGMSSLKCSFI

SEQ ID NO: 11942 - protein, 1041 aa, Psylliodes chrysocephala
MSSAGIADSSIDPPAKKRKLDSKLATPEMANCEASGSSNVGDIDEGLYSRQLYVLGHDAMRRMANSDVLVSGLGGLGVEVAKNVILGGVKSVTLHDDALCTVQDLSSQFYLTESDVGKNRAEACCKQLSELNTYVPTKAYTGPLDEKIIKKFRVVVLTTSTRAEQIRISEITHANDIALIIADTKGLFAQVFCDFGKSFSVVDVNGETPVSTMIADISSDKDSVVTCIDDTRHGMEEGDYVTFSEIQGMTELNHCKPIKIKVLGPYTFSIGDTTNFTKYVRGGIVSQVKMPKELNFKPLKESLQNPEFVITDYAKFDHPVQLHLAYTTLHKYVEKTGRLPKPWNNDDASQFITLAKSLAVNGSTDAEVNTDILEVFSKVCAGELNPINATIGGIVAQEVMKASSGKFHPIYQWLYFDAIECLPQEKTEITEELAAPTGSRYDGQIAVFGKDFQKRLGELKYFVVGAGAIGCELLKNFAMVGLGSRGGQITVTDMDLIEKSNLNRQFLFRPSNVQQSKSATAAKVIKKMNPEVNIIAHENRVGPETENVYNDDFFEALDGVANALDNVDARIYMDRRCVYYRKPLLESGTLGTKGNTQVVVPFLSESYSSSQDPPEKSIPICTLKNFPNAIEHTLQWARDNFEGLFKQNAENASQYLTDPDFIDRTLKLPGVQPLEVLESVKAALVDERPKDFDDCLAWARLHWEEQYANQIKQLLFNFPPDQLTSTGQLFWSGPKRCPEPLEFDVCTDLHLDYVLATANLKAQVYGIPTSRDRCHAKHVLSKVDVPKFVPKSGVKIAVTDSQMAMNGNNVDLDRVTQIREELPSVAELSGLRLTPLEFEKDDDSNFHMDFIVAASNLRAANYKIPAADRHKSKLIAGKIIPAIATTTSVVAGLVCLELYKLARSTKSLTPFKNGFVNLALPFFGFSEPIAAPKMDYCGNQWTLWDRFEVQGEMTLSEFLEYFKEKHGLEITMLSQGVCMLYSFFMAKAKAQERLGLTMSEVVRRVSKKKIEPHVKALVFELCCNDADGEDVEVPYVKYNLC

SEQ ID NO: 11943 - protein, 434 aa, Psylliodes chrysocephala
MADADDLLDYEDEENPEQTTTETTTTEVQKKGVKGTYVSIHSSGFRDFLLKPEILRAIVDCGFEHPSEVQHECIPQAVIGMDILCQAKSGMGKTAVFVLATLQQLDPTENAVYVLVMCHTRELAFQISKEYERFSKYMLNIKVGVFFGGLPIQKDEEVLKASCPHIVVGTPGRILALVRSKKLNLKHLKHFILDECDKMLELLDMRRDVQEIYRNTPHGKQVMMFSATLSKEIRPVCKKFMQDPMEVYVDDEAKLTLHGLQQHYVKLKENEKNKKLFELLDVLEFNQVVIFVKSVQRCVALAQLLTEQNFPAIGIHRGMDQKERLSRYEQFKDFQKRILVATNLFGRGMDIERVNIVFNYDMPEDSDTYLHRVARAGRFGTKGLAITFVSEEGDAKILNEVQDRFDVNITELPDEIDLSSYSKYTTIYKAGEKN

SEQ ID NO: 11944 - protein, 490 aa, Psylliodes chrysocephala
MGVVETDVEMKNADSPGGLEAGDSKKDTDMQSVIEIREHARQIEKAVSSKENRFILRVLRCLPNTRRKLNGVVLRSLINQIYPVAERDVLLGFTEEAATELDTTQSRARSASKTPVPEVDAYINLLILVRLIDTNKLPEAERCSQALMNKITSQNRRSIDLVAAKCYFYHSRVSELTDKLDSIRGFLHSRLRTATLRNDFEGQAVLINCLLRNYLHYSLYDQADKLVSKCVFPETASNNEWARFLYYLGRIKAARLEYSVAHKHLVQAMRKAPQNAAIGFRQTVQKLTVVVELLLGDIPERQIFRQASMRHSLAPYFQLTQAVRMGNLQRFGEVLENFGPQFRQDHTFTLILRLRHNVIKTAIRSIGLSYSRISPQDIAKKLGLDSAEDAEFIVAKAIRDGVIEATLDPQGGFMRSKESTDIYCTKEPQLAFHQRISFCLDLHNQSVKAMRYPPKAYGKELESAEERREREQQDLELAKEMAEEDDDGFP

SEQ ID NO: 11945 - protein, 610 aa, Psylliodes chrysocephala
MRSNHQALPVSTILKSKTEIEDEPKKKSREDWRKAKELEEARKAGTAPAAVDEEGKDINPHIPQYISTAPWYYGTAGPTLKHQRPQEDKQREFSGLDDWYKRGVDTSKIVTKYRKGACENCGAMTHIKKDCMDRPRKVGAKFSGANIAPDEFTQKNLALSFDGKRDRWSGYDPSEHKAVIEEFQIVEEAKRQLKADKLNANESSEDEEKDEDKYVDEVDMPGTKVDSKQRITVRNLRIREDTAKYLRNLDPASAYYDPKTRSMRENPNPERDETYHGENFVRFSGDTTNHARAQLFAWEAHEKGVDVHLLAEPTKLELLQKEYEKKKDEVKSNIQSTVLEKYGGQEHLEAPPKSLLLAQTEQYVEYSRAGRVIKGAEKEVILSKYEEDVYINNHTSVWGSHWRGGQWGYRCCHSFIKNSYCLGEAGKSVNVQPIVESISNEEEIGKPVGDVQEKEKSKEKDEESEESDSSSSSEDNSKVKAQKKLKKKLKKQKKKERKQKRKGKIKEKDEESEESDSSSSSDDDNSKAKAQKKLKKKLKKQKNKERKQKRKENEKEKKKSSVLLDDPEIILDDRKRPYNSMFEAKKPTEDDMEEYFKKRRRDEDPMNQFL

SEQ ID NO: 11946 - protein, 204 aa, Psylliodes chrysocephala
RDHWHKRRATGGKRKPLRKKRKFELGRPAANTKLGTRRIHYVRTRGGNLKYRALRLDTGNFSWGSEGTARQTRIIDVVYNASNNELVRTKTLVKNAIVVIDATPFRQWYENHYILPLGRKKGAKMTPEEEEIFNKKRSKKVQKKYETRQKTAKVEPAIEEQFHTGRLLACLASRPGQCGRADGYVLEGKELEFYMRKIKSKKAK

SEQ ID NO: 11947 - protein, 311 aa, Psylliodes chrysocephala
MDRLLRLGGGMPGLSQAPPPSDAPVVDTAEQVYISSLALLKMLKHGRAGVPMEVMGLMLGEFVDDYTVRVIDVFAMPQTGTGVSVEAVDPVFQAKMLDMLRQTGRPEMVVGWYHSHPGFGCWLSGVDINTQQSFEALSERAVAVVVDPIQSVKGKVVIDAFRLINPNMMVLGQEPRQTTSNLGHLQKPSVQALIHGLNRHYYSISINYRKNELEQKMLLNLHKKSWMDGLTLADYSENCSVNEKTVADMLELAKNYNKALEDEEKMTPEQLAIKNVGKQDPKRHLEEKVDILMTNNIVQCLGAMLDTVVFK

SEQ ID NO: 11948 - protein, 404 aa, Psylliodes chrysocephala
MTVINKMEVDGALKGEGFRSYYITKIEELQLIVAEKSQNLRRLQAQRNELNAKVRMLREELMLLQEQGSYVGEVVKPMDKKKVLVKVHPEGKFVVDIDKNIDINDVTPNCRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 11949 - protein, 221 aa, Psylliodes chrysocephala
MPILYSVICRGSTVLVKYATCAGNFGEVTEQIIAKIPPHNDKLTYSHGNYLFHYVLENRILYMCITDDEFERSRAFLFLNEIKRRFQATYGASADTAIAYAMNSEFSTILATEMKHYSESHDLDTISRVHSELDELKNIMVKNIDNIAMRGERLELLVNKADNLNNGSMTFRTTSRNLARSLFWKNIKLYVIIGVVVTVIIYIIISISCGGLLWQGCLSHK

SEQ ID NO: 11950 - protein, 242 aa, Psylliodes chrysocephala
MFLTRSEYDRGVNTFSPEGRLFQVEYAIEAIKLGSTAIGICTSEGVVLAVEKRITSPLMEPTTIEKIVEVDKHIGCAVSGLMADSRTMIDRARIECQNHWFVYNENISIESCAQGVSNLAIQFGDSDDDGAAMSRPFGVAILFAGIDEKGPQLYHMDPSGTFVQFDAKAIGSGSEGAQQSLQEVYHRSMTLEEATTAALTILKQVMEEKLNSANVEVMTMTPKDFFHMFTKDQVEEVISKLS

SEQ ID NO: 11951 - protein, 385 aa, Psylliodes chrysocephala
MTEYWLISAPGDKTCQQTWDTMNNLTSKQNSLSTNYKFQIPDLKVGTLDQLVGLSDDLGKLDGFVEQVTRKVAQYLGEVLEDQRDKLQENLMANNTDLPSYLTRFQWDIAKYPIKQSLRNIADIISKQVGQIDADLKTKSSAYNNLKGSLQNLEKKQTGSLLTRNLADLVKKEHFILDSDYLQTLLVIVPKSQFNEWNATYEKITDMIVPRSSELITQDHEYGLFTVSLFKKVVEEFKLHAREKKFIVRDFTYNEEELAAGKNEITKLVTDKKKQFGPLVRWLKVNFSECFCAWIHVKALRVFVESVLRYGLPVNFQAILIHPNKKTLKRLRDVLNQLYGHLDSSAALSGPNVDSVDIPGLGFGQSEYYPYVYYKLNVDMIESKI

SEQ ID NO: 11952 - protein, 558 aa, Psylliodes chrysocephala
MSILASPLSVAGSRTTGASVRTQNVMAASTIANVVKSSLGPVGLDKMLVDDIGDVTVTNDGATILRLLEVEHPAARVLVELAQLQDEEVGDGTTSVVIIAAELLKNADELVKQKIHPTSIISGYRLACKEACRYIQDHLTIPVEELGKECIINVAKTSMSSKIIGADADIFSQIVVDAATAIKVTDSKGNAMYPIKAVNVLKAHGKSARESFLVAGYALNCTVASQAMPKKILNAKIACLDFSLQKAKMKMGVQVLITDPNHLEGIRSRELDITKERIQKILATGVNVILCSGGIDDLCLKYFVENGAMGVRRVKKADLKRIAKATGAAFVTSLSNMEGDETFDANMVGEAAEVVQERISDDELIIIKGPKARTAASIILRGPNDFYCDEMERSVHDALCVVKRVLESKSVVVGGGSVEAALSIYLENFATTLSSREQLAIAEFARSLLVIPKTLAVNAAQDATDLVAKLRAYQNSSQTKKDHAHLKYVGLDLIEGTVRDNRKAGVLEPTMSKIKSLKFATEAAITILRIDDMIKLDAEQKGGGKSYHDAMDSGELYD

SEQ ID NO: 11953 - protein, 254 aa, Psylliodes chrysocephala
MFNPLESAPPWWHNGPVPGAFYNFPGTQRIPAANPITHTQSPVTTSTSIIAITYDKGVLIAGDLVASYGSLARYRNCPRVIEVNPNIILGAGGDYADFQYVKSFIEQKIIDEDCLDDGLKMKPKSLYCWLTRIMYQRRSKLDPFWNNLVVGGLQDGVPFLGTIDKLGTAYTDKVICTGYGAHIALPILRDALDKKTNLNLNDAKALIKRCMEVLFYRDARSFPKYQLGIIDKDDGVKIEGPLTVEENWNIAYMT

SEQ ID NO: 11954 - protein, 707 aa, Psylliodes chrysocephala
MLFVVSKVNKMEFSKEPNFDMLTAKDFTPEKYVKKLSQNYVGGSELQNLRRKIKSLSEETSSNLKKNVYENYVQFIETAKEISHLESEMYQLSYLLSEQKSLLSALSTTSILEDMQPINIDRDNKVNEKDFEEENKQKLAAILEKVEGCKELLEVPGRTFLYEGDLLEIDPTENTSLKTVHVYLFTDGFMITNRNSNSRGLMKYVYEIMYDLSSLAVVNVRDLGNVKHAFKLLIFPDTRVFQCSSNSNKKEWLDKFDQAKKTRLAQEQQKRESITEKSPSRSASIESPTYNPFEEDMGTIHPEWFLDIPEELDVCVAQRHFEEALSLLQKAKDYINQTASSSEKHDHVLIDIQRKVEQRQNSLTEVLMKELEVNPDKSLQGGLRAARRAVRLLNQLGRETQSCNLFLKLCSSMLRTQCKRVKREGSTTTYIRHLSSVVFTNMCHMSDEFLRAFPDSPACASAYVVWASNELLQFTTHLIKQVFMPQTSLATITECIILVRTQCERLYGYGIDLCYQLDGALRSSLMKALRDARDKLIDSIKLRALDDKWIPMNLHSKSSLGRCIQEHAQMGLNLESYVSGDTWLQLTASTLSFTKMFLSLLNDCMKLKTTELMYTIDETLYNVFEAQIRHNENALRTELNQEQRTFLTKNAEFLLVNLIEVAQKKYKENVGYECQTLQKLRKEYVALQKGVSPTSRSTKTKYSSEFI

SEQ ID NO: 11955 - protein, 1278 aa, Psylliodes chrysocephala
MNELEKLEYLSLVSKVCTELDNHLGMNDKDLAEFIIHLSEKNNTLETFKKALLENGAEFSDSFISNLLRIIQHMKPKKAANKEEALHIEKEGLAFKFPGLAIPNEAQKPLFLEEKDEKPLEKEKVEEVDIVADMMKQFEADAPSQKQTTTRDRSRSASVERKPKKRSRSRSRTRRRSRSREGNSRRDKTDKRHRSRSRDDRKKRRKDRSSSKTRERSGSRDRRESGRSRDTDKRERNRSRDRRDRSRSRDRRDRSRSRDRRDRSKSRDTDKRERNRSRDRRDRSRSRDRGRRDGSRSRTNRRERSSEKKFKSEKDNPEFEEDPTPGKIYNGKVSNIVPFGCFVQLEGLKRRWEGLVHISQLRAEGRVTNVSEVVARGGKVKVKVLTITGQKVSLSMKDVCQMTGKDLNPHSHAPDEREDKDRNPDRPMNNSTSVLRLPVSIDEGEEDSRKRVTRISSPERWEIKQMISSGCIDKSELPEFDEETGLLPKEEDGEADIEIELVEDEPPFLQGHGRAVHDLSPVRIVKNPDGSLAQAAMMQSALAKERREQKMIQREQEVDSQPSGKNKNWIDPLPEDETRLMARGIGLQSQDLPEWKKHVIGGKKSSFGKKTNLTIIEQRQSLPIYKLKEELRKAVTDNQILIVIGETGSGKTTQITQYLAEAGFTARGKIGCTQPRRVAAMSVAKRVAEEFGCRLGQEVGYTIRFEDCTSPETMIKYMTDGMLLRECLMDLDLKNYSVIMLDEAHERTIHTDVLFGLLKQAVLKREELKLIVTSATLDAVKFSQYFFKAPIFTIPGRTFPVEVLYTKEPETDYLDASLITVMQIHLREPPGDILLFLTGQEEIDTACEILYERMKSLGPDVPELIILPVYSALPSEMQTRIFEPAPPGSRKVVIATNIAETSLTIDGIYYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLSKMLIMSVALQCSDEILTIVSMLSVQNVFYRPKDKQALADQKKAKFNQPEGDHLTLLAVYNSWKNNKFSNAWCYENFVQIRTLKRAQDVRKQLLGIMDRHKLDVVSAERNTVRVQKAICSGFFRNAGKKDPQEGYRTLVDSQVVYIHPSSALFNRQPEWVIYHELVQTTKEYMREVTTIDPKWLVEFAPAFFKFSDPTKLSKFKKNQRLEPLYNKYEEPNAWRISRVRRRRN

SEQ ID NO: 11956 - protein, 417 aa, Psylliodes chrysocephala
MTSKRKNEKNILAKVNFPLYTIKMLSSRHVIVGGGGGSSKTGVENGFEIYEIFHDGQKFGAKEVTRHETGGNVVMNCCVFNDKKNSYLVAGQESHCQLYKVNTKLVEQVKVENIGNDIHIKQRNTNLKPKEQVDNNKNVKKELYYTLNPMDSVQTDFNGSEPLSRVVRINYDGKVLATGGTDGDVRLWKFPSLQPLFILKGHKKEIDDVDFSRHDNYVISIAKDGLGILWDCKTGNERSKLTWKHPEGSKYLYKRCRFGVIEEQKNKSALYMIANAVNPKHKSFLQQWIPEENDLKKYSEFDETLATLAVRDDGRFVAVGTMFSGSISIHVAFSLQKILTVAGAHSMFVTGLEFLSSINTNHSISSVAEAAVLSISVDNRLCIHTVPYRRTIPLWIGIMLLVLTLFLTFLLCAYLGL

SEQ ID NO: 11957 - protein, 435 aa, Psylliodes chrysocephala
KECIEWAKEERRTLLRQRKGRNVAGAGLFERAQSVPSQHDKLLKLNRDDEEDDENIVNKEQDILNLGEKYKKEGKAKELAELIKATRPFLSLISKAKAAKLVRSLVDYFLDLEAGIGIEVQLCKECIEWAKEERRTFLRQSLEARLIALYFDTGMYAEALHLESTLLKELKKLDDKNLLVEVQLLESKTYHALSNLPKARAALTSARTTANAIYCPPKMQAALDLQSGVLHAADEKDFKTAYSYFYEAFEGFDSVESPKALTALKYMLLSKIMINSPEDVQQIVSGKLAIKYAGQDIDAMKAVAQAAHKRSLADFQLAVKQFKHELEDDVIVRAHLGTLYDNMLEQNLCRIIEPYSRVQVDYIAKTIKLPVLQVEKKLSQMILDAKFHGILDQGEGVLIVFEETPVDKTYEMALETIQSMSKVVDTLYQKAKKLS

SEQ ID NO: 11958 - protein, 584 aa, Psylliodes chrysocephala
MASRSKKGSTPSAVQRPASPLSPTRHSRLQEKADLQNLNDRLAGYIDRVRFLEGENNRLTREIQSTQETVTREVSNIKSMYDHELSDARKLLDETHREKARLEIDVKRLLEENDELKADLGKRNKELQLAESSVRIYETRCNESQLKANQAIADAKKAIADAKELEKERDKLRKLLEATRKQLEQESLARVDVENKNQSLREELSFNDQVHQQELTETRTRRQVEISEIDGRLAEKYEAKLQEALQDLRDQYESQMANNRHEIELLYEQKIKNLQAANDRNQNSASAALDELRQTRTRIDTISSRMQDLENQNAGLAARARDLEKLLENERMRHAEDLALLERELQRLREETANQLQEYQDLMDIKVSLDLEIAAYRKLLESEEARLNITPSGLEVAQHSQRSSSQRRTPIRAGAKRKRTLLEESQESSLSDFSINSSSKGDIEVADVDADGHFIRLHNKSNQEVPLGGWQVIRRVGEEETVFKFHRSLKLEGNGYVTIWSSDQNKDHEPPSNLVMKGQKWIVGDNMTTLVLNNSGEEIAISERVKRQISSAHLRHRERSGGYLSEELHHQQGDPQGDEKCRLM

SEQ ID NO: 11959 - protein, 803 aa, Psylliodes chrysocephala
MADTKSPDDLATAILRKKDRPNRLLVEEAVNDDNSVVALSQAKMDELQLFRGDTVLLKGKRRKETVCIVLSDETCSDEKIRMNRNVRNNLRVRLSDVVSIQPCPDVKYGKRIHVLPIDDTVEGLTGNLFEVYLKPYFLEAYRPIHKDDVFIVRGGMRAVEFKVVETDPAPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSEAALQQIREKMDLIDLEDDQIDAEVLNSLAVTMENFRYAMTKSSPSALRETVVEVPNITWDDIGGLANVKKELQELVQYPVEHPDKFLKFGMQPSRGVLFYGPPGCGKTLLAKAIANECQANFISVKGPELLTMWFGESEANVRDIFDKARSAAPCVLFFDELDSIAKSRGGNVGDAGGAADRVINQILTEMDGMGAKKNVFIIGATNRPDIIDPAILRPGRLDQLIYIPLPDEKSREAIFKANLRKSPVAKDVDLVYIAKVTHGFSGADLTEICQRACKLAIRQCIEAEIRRERERALTPNVAMDLDDDDPVPEITRAHFEEAMRFARRSVSDNDIRKYEMFAQTLQQSRGFGTNFRFPTAQGGPQAPGGTGGDQANFQDDPEDDLYS

SEQ ID NO: 11960 - protein, 274 aa, Psylliodes chrysocephala
MGDQFDCALDLMRRLPPQQIEKNLSDLIDLVPSLCEDLLSSVDQPLKIAKDKDSGKDFLLCDYNRDGDSYRSPWSNTYYPPLEDGSMPSERLRKLELDANHAFDQYREMYFEGGVSSVYFWDLDHGFAGVILIKKTGDGSKKIKGCWDSLHVVEVQEKSSGRNSHYKMTSTAMLWLQTNKQGSGTMNLGGSLTRQIEQDAAVNEINPHIANIGRMVEDMENKIRNTLNEIYFSKTKDIVNSLRSVQPLTESRQQQALKQDLAAALQRRQNKSEN

SEQ ID NO: 11961 - protein, 1392 aa, Psylliodes chrysocephala
MERPPRNEPPVEPVNGVVQPLVHPPPDSPGRVTNQLQFLQKTVLKAVWKHQFAWPFQQPVDARKLNLPDYHRIIKQPMDLGTIKKRLENNYYWSGKECIQDFNTMFTNCYVYNKPGEDVVVMAQTLEKVFLTKVADMPKEEFVVESPIKGTKGKKGRGSSGGPGTPSTPVVAAVPPPTPTATGRGRPPATVSSTSATPVATTTGSSGLPLGTQAPATVPGSTATTTIAPATTNNSSLASQQLTTSVGSTHGAGAPLANSLDSSGVLPGNVIPPAQPAKVKKGVKRKADTTTPATAYDYPTALESKSAKISTRRESGRQIKKPTRPEIDCHVPQPASHKPKDKLPESIKACNEILIELFSKKHSSYAWPFYQPVDAELLGLHDYHDIIKRPMDFGTVKQKMDNREYRTPQDFASDVRLIFSNCYKYNPSDHDVVAMARKLQDVFEVKYAKIPDEPVNRIGPSVNNVPVKSESSSSGSSSESSSESEDSEEERTNKKLKLLEKELTMMQEKMKKLVEESSKRKKEKKKNKVKKKPGGVSTAASASTLPNSSSGLGKPSGHGALKSNNNSIADSVDDSIASVVSGADLKMSGVGSNASVESHHPAGGAQGTGAQHPTNKSLNMHHNMAAAGANASAQAKTPKSKGLRGNKPTAATNAAPNKRVKANNKAGAGRKKNAVQPPPMQFDSEDEDNAKPMSYDEKRQLSLDINKLPGDKLGRVVHIIQSREPSLRDSNPDEIEIDFETLKPSTLRELESYVASCLRKKPRKPYYKKVAGKSKDEQIAEKKQELEKRLIDVNDKIGNSKKAPKKDESNKVDPTGAGGPSGRLSSSSSSSDSDSSSSSLSSSSSDSSDSEAGGTTNRPPKKKGNKKSPNVSVGNTTNTSIQKPPQSTTAAPATTQASAIPTVNANVTVTANANVNITPKAKIPPPTTTNNSSTTVPPIVIPPAAPQPVPPTVNANAKQQLVNVTSAPPLVPPISIKPTVINTVEKLTIVNPLPPTITPTAVPQPPKSVALPTPSPDKPKIVSPLGTYTDPIEQSLASLEHDIKQNDPMETIAVSTVQIPTTTLSNPIVSHPHLNLNPNVTHPILQPSSISMDLKTPVTMSGLGAGNMLHHGMGMPMDSDIPSLIPPQASMLHAQNNGFGMKHDFDMSMNNNGISSMGLPMEMSISSMFDPLPQHLSNQLLIKNDPTQDRLDGLGGLLNDKKNIPLTSKSMSQTFGFKTDKTDHNVKNASSWSSLAKGKSPQNNTPGDSSKQQVMDSFKAFQNKAKEKADREKQRLENLKMKRQQREQAERERMRVETERRREREEEDALEKARKAVAEQQQPVSNQRVEELRSSPGEGSTSPGSLSSGSERISERERQRLQEQERRRREVMANKIDMNMQSDLMAAFEGSL

SEQ ID NO: 11962 - protein, 404 aa, Psylliodes chrysocephala
MSLSTARPLVSVYNEKSEEVKGSGVALPAVFKAPIRPDVVNFVHQQVSMNHRQPYSVSDKAGHQTSAESWGTGRAVARIPRVRGGGTHRSGQGAFGNMCRGGRMFAPTKPWRRWHRRVNVNQRRYALASAVAASGVPALVMSKGHVVDQIPELPLVVSDKVQEMRKTKEAVQFLRRIKAWADIQKVYKSQRFRAGKGKMRNRRRIQRKGPLIVYYKDQGLRQAFRNIPGIDLISVQKLNLLKLAPGGHVGRFIIWTESAFQRLDKLFGTWKNPSTEKKGYNLPQPKMSNTDLSRLLKADEIRAVLRAPQKKVVRRVRRLNPLTNTKAMLKLNPYAAVLKREAILKNQKRQLQRDEALAKKRGITLTPDNAVIRTRKLQERRRAQILKDRKSKPKKAAKAPAKPA

SEQ ID NO: 11963 - protein, 1804 aa, Psylliodes chrysocephala
MADFIESEAEVSSEEEEVDHRDRKKAQKPKVVDSSDEDEEDDEERLREELKDLIDDNPIEESDAESDASGGEKRKKSDDEDIDDRLEDEDYDLLEENLGVKVQRRKFKRLRRFEDEESEGEEEHDPEQDREQIAMDIFSDDDDERRSERSHRPAAEPENFGVGEEEEEGEYSDADDFIVDDDGRPIAEKKKKKKPIFTDAALQEAQETFGVDFDYDEFSKYDQDEYEDEEDEEEDEYEEDEEGEKRKRQKKTARKKPTKKSIFEVYEPSELKRGFFTDLDNEIRNTDIPERMQLRDVPITAVPDDSIELEDEAEWIYRQAFCNRTVSNVDAHLSSEAREKMKKGPQTVGKIKKALDFMRNQQLEVPFIAFYRKEYVQPELNINDLWKVYKYDAKWCQLKTRKENLLQLFEKMRSYQLDQLLKDPDAPIPENIRVMKDMDIERLRNVQNAEELNDVHNHFILYYAHDLPAMHAAWRVKERERKKHEKRQARLRLIAEAEEGSEIPEEPEEIDDDEPEVEVLKYANRSGSYALCTRAGLDPLAKKFGLSPEQFAENMRDNYQRHEVDQEHVEPAEVAKDFISPKFANGDEVLQAAKYMVALQIAREPLVRKCVREVFFERARINVYPTKKGQKVIDESHNCYSMKYVKNKPVRDLAGDQFLKLCLAEEENLLTITINDHIEGNTTNSYIDEVKQLYIKDEFSKNVQDWNALRMECVERALTKSVLPDLRTELKRTLLTEAKEFVLKACCRKLYNWIKIAPYSITFPDDDEDDWDTSKGVRVMGVAYVPEYTVSAFACIAAPDGDITDYLRLPHILKRKNSFRTEEKLLKEADLQAIKNFIYLKKPHVITIGGESREALMIADDLRSVIKELVESDQFPVIKVEVVDNELAKVYANSNKGQTDFRDYPELLRQAISLARRMQDPLVEYSQLCNGDEEILSLRFHPLQEQIGKDELIEALCLEFVNRTNEVGVDINLAVQQAHKSSLVQFICGLGPRKGQALLKVLKQTNQRLENRTQLVTTCHMGPKVFINCSGFIKIDTNSLGDSTEAYVEILDGSRVHPETYEWARKMAVDALEYDDDEGANPAGALEEILEAPERLKDLDLDAFAEELERQGFGNKSITLYDIRAELNCRYKDLRQSFHSANPEELFDMLTKETPETFYIGKLVTASVIGIARKKPKPDQLDQANPVRNDETGLWQCPFCLKNDFPELSDVWNHFDAGACPGQATGVKLRLDNGILGYIYIKNISDKPVANPEERVGVGQLIHCRIIKIDVERFSVDCTSKSSDLLDKKHEWRPPRDPHYDVEREDKDNRLEADKKKEKQRMTYIKRVIVHPAFHNISYAEAEKCMVNMDQGEVIVRPSSKGADHLTITWKVADGIYQHIDIREEGKVNAFSLGKSLWIGNEEFEDLDEIIARHVTPMSSHARDLLYFRYYKDFEGGHKDKAEEFLKEEKKKNSSKIHYVISAAKNIPGKFLLSYLPRTKVRHEYVTVTPEGFRFRQQMFDSVTSLFKWFKEHFREPPPGGLTPGTPRLSSGRTPYGSGTPSFSMSTEAIQRVAQNLPSHMVQALSAATNQTPHYPHTPGGYGANYINTPYTPSGQTPYMTPFQTPHTQQTPRYGQQTPSQHIPSTAPPNLNNPFLHPGAATPSQRTPSYRNMASQSPMIPQSPVPSPGSQSSYSSHMSHHTRASYAESLRFQPPESPRNYTGGSRGSYPDGRYGGNNSESMDWQKAAEAWAARSRSTPRSEGRNTPRSMGQRTPRYDMSESDRSRMKSISSKSPRSARSTPRTNTSPHSMSLGDATPLYDESI

SEQ ID NO: 11964 - protein, 739 aa, Psylliodes chrysocephala
MPETKDKDSATRSPERKRRRSKSPERKERKSSKRKDRDGKRSQDDDYNPKDYPRYYGEDRPNSDSYWNKYPRKDNTKVGQRYYDPPENDKTFEKEKNVQEKHVSNKEETVDKSVIKPRERKTVDMLTSRTGGAYIPPAKLRMMQASITDKSSAAYQRIAWEALKKSVHGYINKINTSNIGIIAREILHENIVRGRGLLCKSIIQAQAASPTFTNVYAALVAVINSKFPNIGELLLKRLVLQFKRGYKQNNKSICISATTFVAHLVNQRVAHEILALEILTLLVETPTDDSVEVAISFLKECGQKLTEVSSRGITAIFEMLRNILHEGQLEKRIQYMIEVMFQIRKDGFKDHAAVTEELDLVEEEDQFTHLIMLDDVKEANAEDILNVFKFDEDYEENEGKYKTLSKEILGSDSESGSGSEGSDDESDEEGEEEVKDSGTIIDNTETNLIALRRTIYLTIQSSLDFEECAHKLLKMELKPGQEIELCHMFLDCCAEQRTYEKFYGLLAQRFCQINKIYIEPFQQIFRDTYATTHRLDANRLRNVSKFFAHLLFTDAINWQVLDIMKLNEEDTNSSSRIFIKILFQELAEYMGLGKLNARLKDETLQEHFSGLFPRDNPKNTRFSINFFTSIGLGGLTDELREHLKNIPKIMEAKMAIGKEESEDSSGSSSSSGEESSGDSSAESSSEEEDEKAKKKKTRDTNVKSLESSKSQRTERINGGGYREDKEKYRNKEKQRYSEK

SEQ ID NO: 11965 - protein, 593 aa, Psylliodes chrysocephala
MALKNQVGLKIMNEVIKHKPTKKNGPAVTQPHGAVEWRILVVDQLAMRMVSACCKMHDISAEGITLVEDILKKREPLTTMEAVYLITPSEKSVHALMNDFESPRPMYRGAHVFFTEACPDELFNKLSHHPAAKYIKSLKEINIAFIPAESQVFSLDSPDTFQCSYDPSFAAARNANMERMAEQIATLCATLGEYPHVRYRTDWERNVELAQLIQQKLDAYKADEPTMGEGPEKARSQLLILDRGFDCVSPLLHELTFQAMAYDLLPIENDVYKYEASAGVQKEVLLDENDELWVELRHQHIAVVSQSVTKNLKKFTDSKRMTQSDKQSMKDLSTMIKKMPQYQKELSKYATHLHLAEDCMKAYQGYIDKLCKVEQDLAMGTDAEGEKIKDHMRNIVPILLDPKITNEYDKMRIIALYAMTKNGITEENLSKLATHAQIKDKQTIANLQLLGVNVINDGGPRKKQYNVPRKERITEQTYQMSRWTPVIKDIMEDCIDDKLDQKHYPYLSGRAQTTGYHAAPSSARYGQWHKDRGQQAVKNVPRILVFVVGGISFSEIRCAYEVTNAQKNWEVIIGSSHILTPEGFLSDLATLAG

SEQ ID NO: 11966 - protein, 712 aa, Psylliodes chrysocephala
MMQQYMKELEQEPFDAEEFVERLAWRTLAESKNDGDESEINPALLYESFVQAIKDLNLLHERQQKKCEKLEVAVREDEATFFQEIYNLLEQNKQAMDTFQELDGKINHVATKVLHLGDQLDSVNGPRSRVVDALKIMSHLSEFLSNEPVSSAIFTNCEFIDEAADMIQKLYLISQDLPPKFEATKRKIERKYSDIEKALIEEFVVAMDNENLTRMKEIATVLSQFKGYSQCVDAYIDHSQMGCLSSKDVFISFLNLCKYNNEIIQKVFNNPEQVMAKFVLNIYQLKLVEYIDDKLNSKLGTYNYLQTLYELYSKTNQLSNDLSVFNMGNDKNYLRKLTTNIFNKYINDYITMELKCLKDRCSANLQKYYESKNHQKKQIQSGGFQDLRRDLQAVIGTRANINIAQIENYGGETFLSEELAITIFQDTKQAFQRCQLLSKNNDRASNATQILDRLINSLLIEHVDYAVELGLQAVPVGEGSKNPPVLYFFSVVHQSNNITHLLEKQFMDLVVPLVENTPKYNDCLQKKKFVLEDIERKINTGLDRSLNAISNWVKLYLQSEQKKSDFKPESDDFDTVASSACKNVLNYVNSIIKEIKANLDGNNVTAILQELGVRLHRVVYEHMLQFQYNTAGAMVAICDLNEYRSCTKLLGPLVMELFDTLHALCNLLLVKPENLQQVCSEDSLAKLDRTILHNFIQLRSDFKVQKQTILKV

SEQ ID NO: 11967 - protein, 270 aa, Psylliodes chrysocephala
MDFQNRPGGKTGGGGVASWSETNRDRRERLRQLALETIDLQKDPYFMKNHLGSYECKLCLTLHNNEGSYLAHTQGKKHQANLARRAAKEAKDAPSLLQPEKPRVEPKKFVKIGRPGYRVTKQRDPENGHQSLLFQIDYPEISDVVLPRHRFMSAYEQKIEPPDRKWQYLLFAAEPYETIAFKVPSREVEKTDNKFWTHWNKDTKQFFLQFAFKNENKRTANTVVTRHQLVSGVPPPPMLPVPPPPRPPMFNPIPPPPPMMRAVMPVPPPR

SEQ ID NO: 11968 - protein, 133 aa, Psylliodes chrysocephala
MSIGVPIKVLHEAEGHIVTCETITGEVYRGKLIEAEDNMNCQMTQITVTYRDGRVAQLENVYIRGSKIRFLILPDMLKNAPMFKKQTKAGTAGRGKSAILRAQARGRGRGQPPVRGGRGAWQNQQGAPQGRGR

SEQ ID NO: 11969 - protein, 442 aa, Psylliodes chrysocephala
MATSFTRTPFLRAITARGYSVSALPVSGNPNAEVKCTTLPNKVVVAAVDNNASLTRVSIVFRSGSRNEETDNLGVTHVLRTAAGLSTKNASQFAIIRNIQQVGANLTATSDRETISYTLEGTKEAVERALPFLTEVATQQEFRPWEVSELSNRLLLDIATRPLQLRAVDLLHNAAFRGRGLGNSLFIPKPQIGKISSETLQHYVASNFLSGRTAVIGSGISERELAQYANSLKIGNGEGNTSPSPYKGGELRSNKGGPLAFVAVAGEGTALKNTQEALAFAVLQRAIGAGPQIKYCTADNGIFSKAIGSPADVSSAAINVSYSDTGLFGILLAAPTKSVGKVVETAVKVLKSGCVSDEDVNRGKNQLKTAILLDNESGADIVRNTGTQAALTQSVSSAKSLVAAVESVTTSDVQNALKKAGRNLSLASIGNLSGVPYLDELK

SEQ ID NO: 11970 - protein, 110 aa, Psylliodes chrysocephala
MRRAHAGNYYEPLPQNSNEIEDENDRMTNELQEKIGVLKSLTIDIGNEVKYQDKLLRDVDDDLDKTGGFLGTTMNKVLKLSKGGQHYIILYLFLFSIVVFFILYFVIKFR

SEQ ID NO: 11971 - protein, 496 aa, Psylliodes chrysocephala
MSYPSTLNAKQASREHIMAVSKDFVSKPRLTYKTVSGVNGPLVILEDVKFPKFNEIVQLRLADGTLRSGQVLEVSGNKAVVQVFEGTSGIDAKNTVCEFTGDILRTPVSEDMLGRVFNGSGKPIDKGPPILAEDYLDIQGQPINPWSRIYPEEMIQTGISAIDVMNSIARGQKIPIFSAAGLPHNEIAAQICRQAGLVKIPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPVNVLPSLSRLMKSAIGEGMTRKDHSDVSNQLYACYAIGKDVQAMKAVVGEEALTPDDLLYLEFLTKFEKNFITQGNYENRTVFESLDIGWQLLRIFPKEMLKRIPASILAEFYPRDSRH

SEQ ID NO: 11972 - protein, 391 aa, Psylliodes chrysocephala
MNRGQAGPRIHVPDELREVLLEFTISYLLEQPGDVINYASEYFTRLREVRTTAIIFDQAGDASQEELLSPDESVISRDEEPSITRFSGRRKSVFAETYDPEEDDDEDANKIVYPKSDEQRQRLSSAVGNILLFRSLDSEQMNEVLDAMFERIVKKDELVIRQGDDGDNFYVIQNGTYHVLVSTDNSPEPKHIHTYEDSGSFGELALLYNMPRAATVKAVSEGSLWAMDRHTFRRIVLKSAFKKRKMYETLIESVPMLKTLQPYERMNLADALVPRVFKDGDRIIKQGDAADGMYFVEQGQIIISVLDDSGKEVEINRIIKGGYFGELALVTHRPRAASAFCDGDVRCAFLDVEAFERLLGPCMEIMKRNITDYEEQMLKIFGSKHNIRDIR

SEQ ID NO: 11973 - protein, 808 aa, Psylliodes chrysocephala
MSYMQSNQNRPMSQGYHQGPNDLPMQSSKEQTLLWQQNSYLGDSGIQSGAATQVPSLTGKEEEEMDLFDLDQPYQGFTQEQVDEMNNQLNHTRSQRVRAAMFPETLDEGIEIPSTQFDPNHQTAVQRLAEPSQMLKHAVVNLINYQDDADLATRAIPELIKLLNDEDQVVVSQAAMMVHQLSKKEASRHAIMNSPQMVAALVRAISNSNDLETTKGAVGTLHKLSHHRQGLLAIFKSGGIPALVKLLSSPVESVLFYAITTLHNLLLHQDGSKMAVRLAGGLQKMVALLQRNNVKFLAIVTDCLQILAYGNQESKLIILASQGPIELVRIMRSYDYEKLLWTTSRVLKVLSVCSSNKPAIVEAGGMQALAMHLGNPSTRLVQNCLWTLRNLSDAATKVDGLESLLQSLVQVNVLASSDVNVVTCAAGILSNLTCNNQRNKVTVCQVGGVDALVRTIVTAGDREEITEPAVCALRHLTSRHVESEMAQNAVRLNYGIQVIVKLLNPPSRWPLVKAVIGLIRNLALCPANHAPLREHGAIHHLVQLLMRAFQDTQRQRASVASGGSQPPGTYADGVRMEEIVEGTVGALHILARESHNRAIIRQQMVVPIFVQLLFNDIENIQRVAAGVLCELAADKEGAEMIENEGATAPLTELLHSRNEGVATYAAAVLFRMSEDKPQDYKKRLSMELTNSLFREENLWNPDLGMGPDLQDILSPDQAYDNMYAQGPPSVHSSHGGRPYQQQGYDQIPIDMQGLEIGSHGGGNGSTYSAIDAMDVTSGDQDLNFDTIDQLPTPPQDNNHAAAWYDTDL

SEQ ID NO: 11974 - protein, 267 aa, Psylliodes chrysocephala
MARNAEKAMTTLARWRAAQLGEADKHKKRRPYLASECKSLHACEKWRMQIIREIAKKVAQIQNAGLGEFRIRDLNDEINKLLREKRHWEDQIKELGGPDYQRVGPRMLDHEGKEVPGNRGYKYFGAAKELPGVRELFEQEPPPPPRKSRAELMKDIDADYYGYMDDDDGILIPLEVKAEKIAIQTSITEWVNNKEKNLGDNEEVEENIYAVEGSEDEEETVQQIDGSQQRFVAHVPVPSQQDIEQALLRRRKQELMEKYGVQEDPVS

SEQ ID NO: 11975 - protein, 214 aa, Psylliodes chrysocephala
MATEDMPTFKCVLVGDGGTGKTTFVKRHMTGEFEKKYVATLGVEVHPLVFHTNRGKIRFNVWDTAGQEKFGGLRDGYYIQGQCAIIMFDVTSRVTYKNVPNWHRDLVRVCENIPIVLCGNKVDIKDRKVKAKSIVFHRKKNLQYYDISAKSNYNFEKPFLWLARKLIGDPNLDFVAAPALLPPEVQMDPQWQQQIEKDLKEASETALPDDDEDL

SEQ ID NO: 11976 - protein, 833 aa, Psylliodes chrysocephala
MPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEEGEDAVDDPRKLKPGEIDPNPETKPARPDPKDMDEDELEMLSEARARLANTQGKKAKRKAREKQLEEARRLAALQKRRELRAAGIEVTSRRKKKRGVDYNAEIPFEKRPAIGFYDTSNEALDPMAPDFSKMRQQHLDGELRSEQEERERKKDKQKLKQRKENDIPQAMLQNQEPAKKRSKLVLPEPQISDQEMHQVVKLGKASETAREIATESGIETTDTLLNDYMFTPQAAATPRTPAPQTDRILQEAQNMMALTHVDTPLKGGLNTPLHNSDFSGVLPQAQTIATPNTVLATPFRTTRSEGGATPGSTAGFMTPKSGALTPVGKANMTPSVRDKLNINPEEGLDVGSTPAEHRMFQMSMKDQLKMGLSGLPQPKNDYEIVVPENEDQEEPEQAQAQLVEDQADIDARKQEELKAKAAKELASRSQVIQRELPRPQDVNLTVLRPPHESYSLTDLQRAEELIKCEMVTMLQFDNLKNPVPTINKRTNMSQAQQLAFLEQHPYGSYRKEDLEVAKGMLKKEMDYVKNGMSHGELPLEVYTQVWEECLSQVLYLPNQTRYTRANLASKKDRLESAEKRLEQNRSHMAKEAKRAAKMEKKLKILTGGYQSRAQVLIKQLQDMYENIDQSALELNTFKFLQEQEKSALPRRIQSLTEDVTRQMEREKVLQKKYAEFQIQIKQLQEEYLTQMQSLPNDDASKGEEVSSTTNEETAVDEDDAEMDED

SEQ ID NO: 11977 - protein, 191 aa, Psylliodes chrysocephala
MIKAILVFNNHGKPRLSKFYQYFPEDMQQQIIKETFQLVSKRDDNVCNFLEGGSLIGGSDYKLIYRHYATLYFVFCVDSSESELGILDLIQVFVETLDKCFENVCELDLIFHVDKVHYILNELVMGGMVLETNMTEILTRIEDQNKMEKQEAGIAAAPARAVSAVKNMNIPQQIKDIKLPDIPQAIKDLKF

SEQ ID NO: 11978 - protein, 317 aa, Psylliodes chrysocephala
MSSDSELSDSDVELQEALLEGRLKPGLNKVEKVPKKFINNVSGLKQKVEELKLNLPWIERLDCTSSQAPLAPEFAAQMLIHEEKRSNQLKNNKKLPQFSPSEDPVLNDFKREIMFQRQAQATILEAIPKLKAMGISTKRPDDYFAEMAKTDAHMHKIREQLQKKQEQQKRIERVKQLRQQRKDGKMLQIQTKLQRSQEKKEMLAQVKKVRKGVSKNLDFLDGKNKPSKKIIEKRKMKDKKFGFGGKKRGMKKNTRESAGDISEYKSPGKPGKKFNQNQPGQKFNQNQARQKFTNKNKGKSNRMGKNRRMKMKTKSKK

SEQ ID NO: 11979 - protein, 1294 aa, Psylliodes chrysocephala
MNELEKLEYLSLVSKVCTELDNHLGMNDKDLAEFIIHLSEKNNTLETFKKALLENGAEFSDSFISNLLRIIQHMKPKKAANKEEALHIEKEGLAFKFPGLAIPNEAQKPLFLEEKDEKPLEKEKVEEVDIVADMMKQFEADAPSQKQTTTRDRSRSASVERKPKKRSRSRSRTRRRSRSREGNSRRDKTDKRHRSRSRDDRKKRRKDRSSSKTRERSGSRDRRESGRSRDTDKRERNRSRDRRDRSRSRDRRDRSRSRDRRDRSKSRDTDKRERNRSRDRRDRSRSRDRGRRDGSRSRTNRRERSSEKKFKSEKDNPEFEEDPTPGKIYNGKVSNIVPFGCFVQLEGLKRRWEGLVHISQLRAEGRVTNVSEVVARGGKVKVKVLTITGQKVSLSMKDVCQMTGKDLNPHSHAPDEREDKDRNPDRPMNNSTSVLRLPVSIDEGEEDSRKRVTRISSPERWEIKQMISSGCIDKSELPEFDEETGLLPKEEDGEADIEIELVEDEPPFLQGHGRAVHDLSPVRIVKNPDGSLAQAAMMQSALAKERREQKMIQREQEVDSQPSGKNKNWIDPLPEDETRLMARGIGLQSQDLPEWKKHVIGGKKSSFGKKTNLTIIEQRQSLPIYKLKEELRKAVTDNQILIVIGETGSGKTTQITQYLAEAGFTARGKIGCTQPRRVAAMSVAKRVAEEFGCRLGQEVGYTIRFEDCTSPETMIKYMTDGMLLRECLMDLDLKNYSVIMLDEAHERTIHTDVLFGLLKQAVLKREELKLIVTSATLDAVKFSQYFFKAPIFTIPGRTFPVEVLYTKEPETDYLDASLITVMQIHLREPPGDILLFLTGQEEIDTACEILYERMKSLGPDVPELIILPVYSALPSEMQTRIFEPAPPGSRKVVIATNIAETSLTIDGIYYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLSKMLIMSVALQCSDEILTIVSMLSVQNVFYRPKDKQALADQKKAKFNQPEGDHLTLLAVYNSWKNNKFSNAWCYENFVQIRTLKRAQDVRKQLLGIMDRHKLDVVSAERNTVRVQKAICSGFFRNAGKKDPQEGYRTLVDSQVVYIHPSSALFNRQPEWVIYHELVQTTKEYMREVTTIDPKWLVEFAPAFFKFSDPTKLSKFKKNQRLEPLYNKYEEPNAWRISRAQDVRKQLLGIMDRHKLDVVSA

SEQ ID NO: 11980 - protein, 438 aa, Psylliodes chrysocephala
MNPGAPNYPMASLYVGDLHSDITEAMLFEKFSSAGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDESGVSKGYGFVHFETEEAANKSIEKVNGMLLNGKKVYVGRFIPRKEREKELGEKAKLFTNVYVKNFGEDLSEEQLRTMFEKYGKITSYKIMSKDDGKSKGFGFVAFESPEAAESAVEALNGKELLEGKPLYVGRAQKKAERQQELKRRFEALKMERLNRYQGVNLYVKNLDDTIDDERLRKEFSPFGTITSAKVMMEEGRSKGFGFVCFSSPEEATKAVTEMNGRIVGTKPLYVALAQRKEDRKAHLTSQYMQRMANMRMHQMGQFIQPGGSSGYFVPTIQATAPRFYCCCWKSCSQLQIHRQHA

SEQ ID NO: 11981 - protein, 921 aa, Psylliodes chrysocephala
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSGLVEDQGFLEQLKELLSDSNPMVVANAVAALSEINESSPTGQPLVELSTNTINKLLTALNECTEWGQVFILDSLSNYTPRDDREAQSICERITPRLAHANAAVVLSAVKVLIKMMEILAGDTEFCNTLSKKLAPPLVTLLSSEPEVQYVALRNINLIVQKKPDILKHEMKVFFVKYNDPIYVKLEKLDIMIRLASQVNIAQVLSELKEYATEVDVDFVRKAVRAIGRCAIKVEPSAERCVATLLDLIQTKVNYVVQEAIVVIKDIFRKYPNKYESIISTLCENLDTLDEPEARASMVWIIGEYAERIDNADELLDSFLEGFGDENAQVQLQLLTAVVKLFLKRPQHTQGLVQHVLSLATQDSDNPDLRDRGFIYWRLLSTDPAAAKEVVLADKPLISEETDLLEPTLLDELICHISSLASVYHKPPTAFVEGRSAGIRKTLPARQGSADDSASAPETTVIPNQESLIGDLLSMDLNAPAPSMAAPAAAPTSNVDLLGGGLDVLLGGGNDISGVPTTAAAPTTTGLLGDIFGIPSAPTMYTPPKILWLPAEKGKGLEIQGTFSRRSGQMSMDMTLTNKAMQAMTGFAIQFNKNSFGIMPHAPFSAPPLQPGQSLEYSMPLNTTGPVQRMDPLTTLQVAIKNNVDVFYYACQIPIQVLFSEDGTLDKRVFLTTWRDIPGANEVQYTLNDVKGNTDTVSNKMTLNNIFTIAKRNVEGQDMLYQSLKLTNNIWVLLELKLQPGVPTATLSLKSRSVEVAPYVFQAYESILKN

SEQ ID NO: 11982 - protein, 165 aa, Psylliodes chrysocephala
MPPKFDPTEVKYVYLRCVGGEVGATSSLAPKIGPLGLSPKKVGDDIAKGTADWKGLKITVQLKIQNRQATISVVPSAASLIIKAVKEPPRDRKKQKNIKHSGNITFDEIITIAKQMRPRSMAKQLSGCVKEVLGTAQSVGCTIDGKAPHDVIDDVNDGSIEVPDE

SEQ ID NO: 11983 - protein, 394 aa, Psylliodes chrysocephala
MISILHPIEKVSRYIYTHYWITYFFITSSKKMVEGKRALILVGGYGTRLRPLTLSRPKPLVEFANKPILLHQIEALVDAGVTEVILAVSYRAKQMEEELTIEATKLGVNIIYSHETEPLGTAGPIALAKEHLSKSTKPFFVLNSDIICDFPFRELAKFHEDHGKEGTIVVTKVEEPSKYGVVVYDKTNCIQSFIEKPQEFISNKINAGLYILNPSVINRIDLKPTSIEKEVFPNMASDKQLYAFELKGFWMDVGQPKDFLTGMCLYLTHLRETNSQKLYKGPGVVGNVIVDPTATIGNNCQSGPNVTIGPGVVIEDGVCIKRSTILRGATICSNSWLESCIVGWKCHVGRWVRMEGSTVLGEDVIVKDETYINGGQVLPHKNIATSVPEPQIIM

SEQ ID NO: 11984 - protein, 288 aa, Psylliodes chrysocephala
MASDGEEVISDHEKVKIVSDFILHSPPGEFNEVFNDVRKLLNNDDLLKEGVTGAFAQYNKDQLTPVRIENADHLVLITEYNDLGNNRFFDPRSKQSFKYEHLRKEASDYQPYTPDSATEPWRAALDAEFVQYTRNHYKDGVCSVVGRNQGGAITLTACIEDHQFQPKNFWNGRWRSQWSVSLTDESTAEVRGVLKVQVHYYEEGNVQLVSTKEIKETIPVSNETQTAKEIIQVIENAENLYQTAISENYQTMSDTTFKALRRLLPVTRTKIDWNKIVSYSIGKELKTQ

SEQ ID NO: 11985 - protein, 1286 aa, Psylliodes chrysocephala
MGRCAKNLAKMCLKYFVLVLILSVSIHAQDNSDSTGSVDNTDNNGQDNTGDVESINVDTGVVKAVPDGTDSKPIPVEEGINAISPTNPNYEEPVEVLTDIVSDTNTSKPNWTYQKKSKSGRYITYYGADYDPMTSDTAPPDSDQRGGIPYTITETRLAEIRKHFMYPFFDKGGNADNEGDYQKEIQSSTPQVHKNLNFQLPFFGFRYNYTRVSINGYLEFSDPPPNFDYPLVFPVKEWPKKNDPSFIGIFFSKCKIGNLRDGDIDQRKPGVYFRLERDLRVRQDRMGVELRERLKWDIREGVIGSHTFDPKHAIFITWKNISFNGGYANAVYQTNTFQMVLATDEVFTYAIFNYLNLDWTSHTEAGGDTRKGEGGVPAYVGFNAGNGTRSFEYLPYSQASVIRDLTATGWGNNFQGRHIFRIDENILLGSCNKDIDGANLPLQFAPESGNMLGGTVVNITGPCFNLNDRIRCKFDVSDEVVGHVVDRNRAICVQPLLYSEGWVNLQIAVNSEAFKWKGKYYVESPSSATQKIFFKDMKYHEKSPSEIRITWERQNLTSNDNANIRISLWGYRETTMRPTFVYIGEIAENIQNTGEYTIVPSQYRTRANQFLTDIKFGFLQINLTESIKVNTYTTSNQNIDITPVVWSRPIPLGWYFGFQWENLYGRNWPKYLCDEWLRTDRYLKNFAHELPQCPCTVQQALADKGRYMPDFDCDKDSNPICYYNNQALHCVKTGSPTLEGSEQQCCYDKNGYLMLSYDQQWGSSPRRCHNLGKMPYNEATKVPTLSQWFNDVVPKYLCCLWQEEQAVGCETLRFERRPTQDCVAYQAPGIAGVYGDPHVVTFDDVEYTFNGKGEFSLVKSVTKLDNLEVQGRFEQMDPNAYGEVRATQLTSIVAKGNNTISVEIRRRPLDSRWRYRLDVIADNRRLYFDRPSLKFQHFQGVTIYTPTYILNQSEVLIMFDNGAGVEVLDNQGYMSARVFLPWSFINKTVGLFGNWSFNKEDDFALPDGTKAAVVSNINDMERVYNDFGSKWMLDDVLDPQKGRALFYREFGRSSSTYNNKTFKPQFLMMPEDIIPANRSVQIDRTYQICSTRMYECYYDYAMTLNRDVAHFTQNYKSTIYQLKDIARTKVPSCGVLETPRFGRKSTFLFVPGTKVTYECIQDFVLVGDQRRECTAEGTWNTPDYGYTYCLRQQEYSQRQAGITSGIIMIVLIPLILLFVYLAYRFLKKKQKEKEETQHQALMYQEQKRKAQEAATRKITEAEEYNSEEDDNNSNLTSTGAKETNIY

SEQ ID NO: 11986 - protein, 106 aa, Psylliodes chrysocephala
MRYVAAYLLAVLGGKASPNAADLEKILGSVGVEAEGEKLKKVIGERNGMCVEELITQGREKLSSLPVGGGAPAAAVASAAPAAAAEQKKEAKVEEKKDESESEDDD

SEQ ID NO: 11987 - protein, 910 aa, Psylliodes chrysocephala
MMTDRFGLKWDPKNLEIRTMSVEKTLEPLVLQVTTLVNTKGPSKKKKGKSKRANALVSTVEKATENFIEKGEQIAYENPDITDEMLAAVDEVKKTGTAMSIAAREFSEDPCSSLKRGNMVRAARNLLSAVTRLLILADMVDVHLLLKSLHVVEDDLEKLKNASSHGELLDNIKAFGQNANELMNQAAKRQQELKDPQLRDDLAAARAVLKKHSTMLLTASKVYVRHPELAAAKANRDYVLKQVCEAVNTINDVAQGRTPQPASGPYDGPGELAAALDDFDDHMVMEPLAYNEVHTRPSLEERLESIISGAALMADSSCTRDERRERIVAECNAVRQALQDLLSEYITNIGNKDKSESLNRAIDNMGRKTRDLRRQLRKAVVDHVSDSFLETNVPLLVLIKAAQNGNEKEVEEYAVVFTEHSNKLVEVANLVCSMSNNEDGVKMVRYAAAQIDNLCPEVINAARILAARPRSKVAQENMEAFKQSWEHQVRILTEAVDDITTIDDFLAVSENHILEDVNKCVLALQEGEADTLDRTASGIKGRSNRVCNVVTAEMDNYEPCIYTKRVLEAVKVLNDQVMPKFTQRVQVAVQALGNSPPKEVDENDFIDASRLVYDGVREIRRAVLMNRADEDLDPEDVELDENYLIETRSKSSAHTGEHGVDEYPDISGITTAREAMGKMPEEDKQKILQQVEFFRSEKLKFDREVAKWDDTGNDIIVLAKHMCMIMMEMTDFTRGRGPLKTTMDVINAAKKISEAGTKLDKLTRQIAEQCPESSTKKDLLAYLQRIALYCHQMNITSKVKADVQNISGELIVSGLDSATSLIQAAKNLMNAVVLTVKASYVASTKYPRQGTVAVSISPIVVWKMKAPEKKPLVRPEKPEEVRAKVRKGSQKKVQNPIHALSEFQSPTESV

SEQ ID NO: 11988 - protein, 337 aa, Psylliodes chrysocephala
TTTTPQFGLPTSKPGTTTLSSLLGSAPAAVAATTVSTGLGFGSTIGATTATLAPTTVSTGLGFGSTIGATTATLAPTTVSTTTATPATGASLFGSTSTSVATIAPGLGLSTAAPTAFSTAASTALSTTTVAPTYSTTTLPSTGSLTFGQLEDSINKWTIDLEEQGKFFINQAKQLNAWDSLLITNGEKILNLNGSIERVKQQQQQLDQELDFVLAQQKELEELITPLEKELLEIPVTDIDRNQMYQFSEIIDSQLKQMSDDLKEIIENINESNKNEEISNPITQISRILNAHMNSLQWLDRNTSQISSHLEQISKIQDTNRRNFTQNHSFNNNSFNM

SEQ ID NO: 11989 - protein, 189 aa, Psylliodes chrysocephala
MWIVNWFYDVLSSLGLLNKHAKLLFLGLDNAGKTTLLHMLKNDRVAVLQPTLHPTSEELAIGNVRFTTFDLGGHPQARRIWRDYFPEVNGVVFLVDAKDEERFAEAKAELDALLAMEELAKVPFVILGNKIDHPSAVPEDRLRHELGLYQTTGKGKVPLEGIRPIEVFMCSVVMRQGYGDGIRWLSQYV

SEQ ID NO: 11990 - protein, 187 aa, Psylliodes chrysocephala
MDPIAVLEKRIEALELQVFPLGDHSQISNKTQTITDLLSETQTMIKSALHCRESITSMLQHLVIINDYLNPAGDADELEVEAKRQCLLELYPELKDTVQTISTLESLLPFIDSINISKVVEFSGKLEEIALSNLKLYGECRDITKKVLVALQNYNDISNSIKLLFSQLDTAISNLENALQLRVVSEE

SEQ ID NO: 11991 - protein, 583 aa, Psylliodes chrysocephala
MNNAKLQEVYSDLTLYTTPDKFFLEPKTGDELMVIERASENIVCFKNNHRHLIPAANSRKDFCGLIGIVHLLACPYLVVAVQRELVGYIAGCAVWRLVKAELIPFRSALHLPPEKQADNEIYLAMVESVLSTPFLYFCYDYDLTHSLQRLHGISPDFWNQSIWDRADQRFVWNGNLLTPFKGLYIQKFCLPLIHGFISINFCVINGHSLNWSIVSRRSVQRAGTRLHRRGIDKDGNVANFVETEQIVEYQGDHASFVQIRGSIPLFWHQNPDLRYKPPPTLLEVDPQDHHSTCLRHMNDLMTMYGKVVCVNLVDQKGAEGNMEIAFQNAINNMSSPSIRYEYFDFHAECRKMRWDRLSILIDRLSHDQDEMGFFLLLRDGSLSSLQDGVFRTNCIDCLDRTNVVQSMLAHRNLESVLKKLQILQQNQTLDYQYSFELLFKNVWADNADIISTQYSGTGALKTDFTRTGKRTKMGLLQDGLNSLIRYYKNNLTDGYRQDSIDLFLGNGKPISPLHIDKGWRYVTYPSVLLIAVAMFVACAVTPSEYSTDSLLFLLFWGSMVYATLHTILKYGSEFVDKPRLTQS

SEQ ID NO: 11992 - protein, 588 aa, Psylliodes chrysocephala
MPPTIQQNNQNATNGVEKRPVKTIEKRSDLLCKVKYCNTLPDIPFDLKFISYPFESIRFIQYNPTSLERNYKYEVLTEHDLGVNIDLINKDIYAIGSGVTLDPADEKLLEEDILTPQDSKRSRHHAKSVSWLRRTEYISTEQTRFQPQTMDKVEAKVGYSIKKSLNNETLYMDRDSQIKAIEKTFDDTKLVIDKHYSKPNVVPVDILPVYADFSLWKYPCAQVIFDSDPSPSGKQTPAQIEEMSQAMIRGVMDESGEQFVAYFLPTEETLQKRREDFIKQIPYQDDEEYEYKMAREYNWNVKSKASKGYEENYFFVVRPDGIYYNELETRVRLSKRRQKIGQAPSNTRLIVKHRVMDANEFRMQRYREKQLEPPGEEDEEMEIDEPKYDDTVQEQENEIEVESDQEKTKDVSNTGNKQRKAFSRSRSNSSARSDKSRSRSRSTSSSKSNKSRSRSKSRSKSRSRSKSRSKSRSKSRSKSRSKSRSRSRSSSKSASRSRSVSKSSSNSRSPSRSKSRSVARSRSVSRSKSRSRSKSRSRSKSRSKSKSRSRSKSRSRSKSRSRSKSKSRSKSRSRSKSGSRSGSSSDSE

SEQ ID NO: 11993 - protein, 389 aa, Psylliodes chrysocephala
MPIENLEDQGLEKNPDLGLAHCKFLLSLPEYRNDRSVHSKITEAIKKDDMAPWYELICKDAGWKLDAALLKTLKAKNDEKIKLLDEAIEDAEKNLGEMEVREAYLRKSEYYSRIGDKDNAVITFRQTYDKTVSLGHRLDIIFHLIRIGLFFMDHDLITRNIDKAKTLIEEGGDWDRRNRLKVYQGAYCMSVRDFKTAANLFLDTVSTFTSYELMDYKAFVRYTVYTSIISLPRNQLRDKVVKGSEILEVLHSEPFVKDYLFSLYNCQYAEFFTNLAEVESILRKDYFLNPHYRYYVREMKISAYTQLLESYRSLTLQYMAEAFGVTMEYIDEELSTFIAAGRLHCKIDRVGGIVETNRPDLKNAQFTSVVKQGDLLLNRVQNLSRVLNI

SEQ ID NO: 11994 - protein, 5272 aa, Psylliodes chrysocephala
MEEITSGLDPDELMDLDEPEGSDLEDDEEDLIDDHISSPFILSSAPESTANSVASSPISEDCHPPFNFTGKPLNVKRGRGRPRREGGKPTAPRSSRGGMSSVSRVRKPRPPGFSRRGALGSRSIRQVDRSDYELSLFTPSPIEDNGFLDPETGSIIYSDREKYIPSIEDPPYFPEHWPGKVCALCNLGERSQLGQGELLRLNCPDGFSPHKVAAEQILERALQAPDKEAGDKSPKGPVTCRRQKSFNKCRHPSMTSEYIDELTIIGYNEVPDVSSLFELNGQFYIHRNCALWSQGVTKAENSALLNVGPVVLQNSSKKCSFCNHYGASLACNKDECNKIYHFPCATASGAFQEISSSATLCSDHFGQVALLNNASPCLTCGSMGDIANLMFCSGCGAHYHGICVGLAQLPGVRSGWQCRKCRCCQVCRVVGDESKLMSCEQCDKVYHAGCQRPIVTSIPKYGWKCRCCRVCGDCGARTPGAGLSSRWHAHYTVCDSCYQQRNKGFSCPLCHKAYRAHAHREMVQCFSCKKFVHGTCDADADVNTYNQKKDMNPEYEYVCLHCKHSTARQITSKRASIDDSYDISVSRDSLYDDTSEFDLPSPDEFARNMGLGKGKPYNASKIAKKRLSFTVNSVGRPKGTGKVPPGKMGFMKRSRLTDFNRKRGHKAKMRGIFGVPGVGLQRPISDGKNDEEPGVENRLVLCSAKDKFTLTQDICVMCGAFGTDQEGCLIGCVQCGQCYHPYCINVKVTKVILQKGWRCLDCTVCEGCGQRNDEARLILCDDCDVSFHIYCMDPPLDYVPHGNWKCKWCAICLSCGSTDPGFNCTWMNSTTQCGPCASHINCPSCNDPYSEGDLIIQCVQCERWLHGSCDYIKSEEDAEKCAEEGYNCILCRPRDVPPPHLIPPPITPKPPTPTKSPEVGRSTSFYMDGVYLSEFGNNLIKSLALEYHGSRKKRKKIPTVQDKEAGIMATIESVVAGGNIGPTNLDDSAKLELVDIKDEPQELYKEGMTWTKEDGPPPEGFAVVTMENGVNVLRRKRQRNLQKLGIGGFLVRMRGIRTGQDNDDIDQSVGQSGSITNEISTPLPGDGDKPRRKAIRRKPKNKLAETFPTYLQEAFFGKDLMDVVECKKEVDSYSSEDEKSDSYYKSINLSQDELIAVAAVSGKNERLENINKDYTKEMKVNALKEEEDDDNTEDLKDVLALPGDLLDTDLVNSIMEDDEELTKNTASLEGLDSNLQDESELTDTLGSSGNSKETKDELSDILGPHFNLDSISNINSKDVEDIFKGVLTDESQESQESSNFSLQGNSIFTNNSSQQSIAQHSIINQPVRPKTLPNVNHVNLNSPVSFPPPSPYHSEYSNSPQFSPAFTESPSAWVGVTETPEIDSTNVGVPSTYNQRSSEKMKADESLGNGATISAVLYANINHPEWKKEFPNWSDRYKHIIKKWRTLTQEQKAPFLQHARDNRSQLRMKKAQQSQTSKDSTSATTPPNVTKPLHAAPALVTTLQAVTQQTVGVSIAPTAPVSEDQEKIALQQKSAREAEQERQWKQLQALRQQQTQQQQNIIHEQRVQDNCTAIARVQRQISTDPTQQFLTEQQSPLQVNTPQELSPSTTPTTPSPRQFLGIKSPTFPVPSPVSQSSVRSTTPLQSPHDISQPGTPDGNDPFIQSPTIPKPNFQPRLPNDPFAQQPATPRPQFGLSRPQLQNFGGAIRTDQQDLNINRQLRDLLQRQQVKKLDEIPGKLQQQRVWHPVEQQQENEASITAPTSTSAVSTVASMSDATFRQPLPPSIVKPRLALSLAGRTAPSAVRVSQLDPRMQGLDPRMRLILQHQQQRLATGIQQQFIRFTSNARPTTVEQYEQLLQSNNPGQIHSDEQVIPRMPLNQASVIQRPQISQSAPTSTPTISNTTENNPSEEGIPDNVTAELEKLEQETGTMVELQGVSDILGGLDDDDELLAEMGADFNILEYADPELEALTGGKTNILDLELEEEPVKKEKVVAPNAKEAPSNSISAKSDANVETKIENNVQKSIPKPVQNPLPPSSSHQIIQQQNIAQHTTSMQAQQQPPHPQQQAPHPQQQAPHSQQQAPHPQQQVPHPQQQQQQVPVQSTIQIQQIHQQMVHQVQQAAAQGRPMPPGSKMQTTDGFVGIVMANNTVQLQIPQNYQQRLLVLQQLQNQKLQMRIGGKPSRAALQVGQNQLSVGLNSGPPRMTVPAPPPPPPPYPGPPPPYPGNANQHQQEQPLLLEDLLEQEKREQEKLQNQPSNQEVSSSTGNESESALLSDQDFERLKADVFNSTPVNSISSVNQGNAGQTSQSWQQQLAPTRQAPTPAPPPQPTMEITTRVQMFNPNLIPAPPLPPENIITEQDKQTQLLYEQWLNHQHNALAQQLHYYETEVQKLRKSRKSLNSKQRQLRKSGNQLTDTDAAELQRISAEQAILQKHLESSRKQSRQHGMLIQEYRNKHPVIKQRTGSDQIQSPLGPPASSPIQQPSTSLSPMLSPSVSPMTQNSSPLNSPGPLIPSSPGHVQNLLQSPNSISATNMSPLQSMQASPMQSSPLQSSPRIGTPHSQSEESPGPIQSPSQVCLPPPMPRMTSPQHRRVVTSPVGMSQMRFINNTVLQQRVRMQSPIPNFQQKPGTPSPLNSPTSQQINVNQLQIQKQLQQQTILQQQQLHQQTLDTNLVDPNALHSQRTTQLLQHRNFIRQQVTQQQIIGQPQTLTPQQHQIMLQQQKQLAQQQQQQIAQMNAARLQQQQQQQQQQQNNPPHSPMPPKSPMIMSPHSMPHSPMQMPPKSPMVSFSSSQPNPNSPAARSPAFHQGMNQPTSPITHGLNQPPSSPMPRSPMINQTQSPHMRRPPSASNSPAMPERPHSVENASPRMSYSIDHLMQDNLHSQNRYTDSANLYNSDMNNENSIRESLSSGGGNPNNPCNPIPLPPEIPRYRYFKLGLRGGAPMWGFGRGAKRLPTPPNVPNKPDEKVTNQESLIQKLKKESHLSKVSILKRKGSTSSMGKMGSLVSSDYNDLDDSSSTPPVTPPLASTSRGTLPKITSKKTMEHQGQKESVIVMHSPDNKQLEMMDYDDDTNTVLSAEVSLSSVAQNDDDMVEIETLSQQDLAEGLASPLESDQIAEDFLLFPGNMVVDLSGGGHYSEKEDEEEQNDDEFNEENMHIVIRSPTTSDDEFIMQSKGKKYNVDVHHDERDDNLESPEQEEYTEPSEIVNDMMTNYEESDVMLTDQNSSTPEDSISTKEDFEELIDEGSRKNNITKHDMPSKHIQEFHKYTGMFNYPKNDTHSMRPQPNKIPTTSKKLPQKISLVTGPIVHTLPPVSKSNADKIIITQNSNVLNTSQASKVTSIILTHNSAMRRNILNVPKIVSSVSPAITIVSASTSQMASILPSKFTVPVISASAVRQLSNVKVIDKPSSSSLSISTRDNALPKKIFEDDSVSPDSSNCGDEKSKDSFDDKTNSQEPKSMFMKTDNLNTLPVMSRNMEFKSKNYTDQPKKVEHLQVMNLATKDFAQKQRIPSPLISKTSPPVIIHNTPELKMTAQVIQETQTRMKITATTDHLDHYDGSVDDQKSVVISIPSPTPSQEQMLDNIALQALENRRREFDSIEDVLDMIENITAEPPSILEENTRVRNTDNNSKIEIKDNNDMKEKPVTKSETLNLSSNSKSSIVPQLSPLSQPTDLTTNMANASQQLRTLLSSLQTTSTSAPTNVESVVKNFGHKISSSTSSASQPIVASRVIQQAGRHSPVITNVSTVIVPNFKQKITVTSASTSRSSPVKQVSNSAVITSTLNYLPSRTVGGIQLMPDHPKLPPVTSVQQINSVTSSQQATAMQKNAPNADIKKPSLTLTAMLQNQPAANMMTKPSSDTITAASLLGSPISLPKTGFTTSLVQAQPSVVVPNTSTTIVTLQNQISTVGTAAKTTDTITAASLLGTSINITKTGFTTALLQAQPNPCVTSLSSNVTSSAALSNSSNIITSSTHKVPTSTTNLLHTQLTKVVRSKSVDDVKDVIMKQEDVKLSHNESLNILEDSKASVLGNSGCKLSTIPTPVINKTEDSQNVLLKKLLQNTACASTQSPPPSSTSTTTTVANIPKPPIRETSFVSNPNVEQPVSQANSSPIVTSQQMNLKKFMPTNRSTSKDELLSPQTPRSVNNNQDLNIQMPAIVKKEVIPPPQSSPLLMPLEVKKEFIDESSQHSEVSDHSRSDVPIKEELESIDNTVEKVLLDKEEIKKQKRRMYQQKRRQNQILNKELAGQPKKRPRKNSKIEEDYDTYIDGVLAQLRQLPPITVSEPVLNRNFGVVPLFGSGDMSKIGTKDYSIQFGELVGNYGYSELPTFSDFYSTKPYGDLDPIPEKSPSSTQRGFYDQEFPLIRFDTDEHKKFDMFCREDTPDSILSSSSPECVLNEPHSKFIGFKLITDSEDEEEETGKEMLSRGRLSPVVPMIRPVPIKLKPVGGLYVKENPNENKENIQDSVNVLTKSKFDNKQSPPSNDSGHVTVTLTLTSSAAEDIMGVLRDLANILHIPAPTSYQIVERTTSPPSQKLGLYRTKGKDGKEGAPIDIQSILNGATKFCKHCDVIILSNIIRRKVSDLPFLAKDSDLLSDGEELFFCSSTCYMQFALMHRSPSISEGKAAEIINHLSQKDNLEAKQKLPMMESLDNKSIIAQRLTFGMKDVKREFEPMDTNNPFSYFARSGIKQPSFFDGVSYKPAPVKMYKNIKYKLWAPGCLQPNQKHKIPTDKEIMELLYRMQITVAPSVMPEDFRRCLFCQGIGDGVADGPARLLNFDVDKWVHLNCGLWSDGVYETVNGALVNVENALQSGSGAYCIHCNNSGATIRCFKNRCSSVYHLNCAVKDNCVFYKNKTVYCKTHAPKNEKDNELTTLSVSRRVYIDRDENKQVAAVMHHSDSTDLLRVGSLIFLNVGQLLPHQLQNFHTPNYIYPIGYKIIRFYWSMRQLNKRCKYICSIHELCGRPEFRVIIQEPSEEDLEFSDATPKGAWQKILDEVSNLRKENGCLHMFTKFATGEDLFGLTEPAIVRVLESMPGIETLSDYKFKYGRNPMLELPLAINPSGAARTEPRLRSQLHWKRPHTQRTTGGFSVRPMFGPSLSVPSFSTQTLGELACPYSKQFVHSKSSQYKKMKQEWRNNVYLARSKIQGLGLYAARDLEKHTMVIEYIGEIIRSELAESREKQYEAKNRGIYMFRLDEERVVDATLCGGLARYINHSCNPNCVAEAVEVDRDIRIIIFSKRRILRGEELAYDYKFDIEDDQNKISCMCGAPNCRKWMN

SEQ ID NO: 11995 - protein, 1501 aa, Psylliodes chrysocephala
MEDSAQDRRSSRRSKGDTSYKAKAFEKFKQLKKGIKNKYEVDDIDNVYEVVEEKEYVKEVLSRYEDDWIVDDDGSGYVEDGRDIFDDDMDLQSIAQASNKGKGTKRKSKNLSENAGKGKLQQMLSSMPTKKKTETKIDDDDEMLSEILGEIDSPSTSVAKPKIKEYSVLAKKLAAKNYMKNFSQPIKKRAIERKSLPTTETPEKNSTPLKEVTANVEQPTKQILEPVHAKINQAASPVVDNNKKFDETLSDQFTEDISFDDFNETPTKITETQIIDTEMTQEEFDDDFDVTLIEEVESKLSAAGEKLADNIQADFETEWENFSNTSVNVDSNNQNLLDKTDIPLEEVDGQKVFRFFWWDAYEDPVHQKGSVFLFGRTYCEKTKSFMSCCVAVRNIDRRIFVLPRPFELDNDGQPTDNAVTIKNVYDEFNNTILKPLGVKSFRTKPTMKKYAFNPNIPSESEYMEVRYAASEPRIDVENLPKKIRTFSKIFGTNTSFLETLFLDRKIKGPCWLDISNPVPVSNPVSWCKFEVNCMKIVDLKLTPSEKPLPPPPLVVATINMRSCINRRTGTLELVMLSCLAHNEYEVDKQPPDPPFQQHFCVFTRPSKIKGPCWLDISNPVPVSNPVSWCKFEVNCMKIVDLKLTPSEKPLSPPPLVVATINMRSCINRRTGTLELVMLSCLAHNEYEVDKQPPDPPFQQHFCVFTRPSDQPLPSDIHNALGKYKATKVQKMDSEKGMLNFFVNKFTEIDPDLIVGHDLQGYQINVLVNRLLTLNNVSFNKLGRLKRTDKKALEKSLFAGRLVCDMKVSAKELIKSRSYDLETLCQVVLKLNDNQRIELEPEDIPKMFKTSDDILKLISFTMQDTMYIIKMMYGLNVIPLALQITNIAGNVMSRTLMGGRSERNEFLLLHAFSEKGFILPDKEYKKKIPGQKGSKKKPTYAGGLVLDPKVGFYDKLILLMDFNSLYPSIIQEYNICFTTLPVTEEDDNLYLPDSSLPPGILPTEIRKLVESRRQVKGLMKRPDLSNDLRVQYDIRQMALKLTANSMYGCLGFANSRFYAKNLAALVTQKGREILTNTRDMIEKMSYNVVYGDTDSIMINTNILEYEQVFKIGVKIKQEVNKLYKQVELDIDGVFKYLLLLKKKKYAAISLAKDKNGGLVTTKEYKGLDIVRRDWSQLSCEAGKYVLDQILSDQSPDDRIENIHEYLRKIRADLEEGKVPIPLLVITKQLTKEPHMYPDKASLPHVQVALRYNKNSGGHFRSGDTVPYVICEDGTRNNAIQRAYHVDEMKNNPVLKIDYNYYLGQQIHPVVTRICEPIEGTDSYQIAECLGMDLKNLKKPQKQSTDQIVGENICRPEIKFRNVDTFKFVCYVCKQENIVDGPLVGATPFLEKCQNADCKSRPIDYLPCIQNQVTLSIRSYIKKYYKSVMICEDPACTNETRKLPLRFVRKYPLCNVCKKGVLFKVYNEQQLYNQLAYFQHIFDLGKLLRKPVMDRETESGYHA

SEQ ID NO: 11996 - protein, 465 aa, Psylliodes chrysocephala
MAAAAAAKIAEVRETTRVERIGAHSHIRGLGLDDSLEARHVSQGMVGQVSARRAVGIVLHMVREGRIAGRAVLLAGQPGTGKTAIATALAHALGQDTPFTSMAGSEIYSLEMSKTEAITQAIRKSIGVRIKEESEIIEGEVVEVSIDRPATGVGTKVGKLILKTTDMETVYDLGGKMIDSILKEKVQSGDVITIDKATGKITRLGRSFARARDYDATGQQTRFVQCPEGELQKRKEVVHTVTLHEIDVINSRTHGFLALFSGDTGEIKPEVREQINGKVAEWREEGKAEIIPGVLFIDEVHMLDIECFSFLNRALENEMSPIVIMATNRGITKIRGTTYKSPHGIPLDLLDRTIIVPTQPYDEKELREILSIRCEEEDCQMSDNALAVLTRICKETSLRYGMQLIMTSSLIARKRKAHEVDVEDIKRAYTLFYDEGRSVQFLREYQQEFMFNDLDDKDDMEVETN

SEQ ID NO: 11997 - protein, 374 aa, Psylliodes chrysocephala
MALRTYGDKPISFQLEENGEYYCVGSEVGNYLRLFRGSLYKKYPGMFRRSITNEERRRLIELGLSQHVLASSVSLLRAGEVEDIIDGNDDKCSRYKAVSVHTSEPPMPRESKSKKNMQWVPSLPNSSHLDAVPQATPINRNRVAAKKVRTFPLCLDDTDPQLNIENACQAEVLVPIRLDMEIEGQKLRDTFTWNKNESLITPEQFAEVLCDDLDLNPLTFVPAIAQAIRQQLEAFPADPPSIIEESSDQRVIVKLNIHVGNTSLVDQVEWDMSEKQNNPEDFALKLCAELGLGGEFVTAIAYSIRGQLSWHQRTYAFSEAPLPMVEVPFRNPSESDQWAPFLETLTDAEMEKKIRDQDRNTRRIRRLANTTPGW

SEQ ID NO: 11998 - protein, 103 aa, Psylliodes chrysocephala
QVELALWDTAGQEDYDRLRPLSYPDTDVILMCFSVDSPDSLENIPEKWTPEVKHFCPNVPIILVGNKKDLRNDPTTINELKKMKQEPVKPQDGRSMAEKINAF

SEQ ID NO: 11999 - protein, 1335 aa, Psylliodes chrysocephala
MNTSSYIQRMDATQNQVQKMELASRNIDNSLLLDNNSPRLLDFMNLHPQSGSTASGFADHDYPTLSGGPHIINNMTQIKCINSVPLPSEIVDHFARVQCHCMMGLFSEINRAWLTVDSDIYVWTYEENTDLAYFDGISETIVCVGLVKPKVGVFHAFIKYLLILATSVDIVVLGVTFTENPGDNSDEIQLIPDPVFTLPTDGSTVTIINSTEDGRIFYGTKEGNLFEITYQAESGWFGKRCKKINLSTSTLSFLVPSFLNAALSDVDGIIQISIDDSRHVLYILTEKGSIEVCDLGEKGNSFSRVSKMSQGTLVNQAMNTVKTLDSQNFRPIVSISAIEASESANLNLVAVSQTGVRFYLTVVSLSNQQPNQRPYTLTLAHVRLPPGYSANITVRPRSVHVSHYRDRNLVLISTVNEKDVLWCMSSDLFPFSQTLMEAYSAVNLDGPALAISEVRNINPLQIHDLHEAPPLVVRQHAEPPKKYVVLTSHSVQIFIKLRPVDLLKQILKDSHGQDTGALKAFFTIQKEDQACATSLILASLENEDNMEVAEYATRAFFLFGGEPKLAHGNIYSGQSVFAPPIISTPAPHQYQQQQFQSQQYHSFSQTMSPTGSAYDLSSPFIFSPKHNGLYLYLSRILRPIWNRRTVDKLCLDGKTITTNSTVSSEDCIFILNNLSALHNFLMRNTQLSTLNTSQSQNPNTFNNTSLNMTRLNHTIQDAQLEERMSLNALKIFVCHCCQILGLWRILCEHQFHSLIATLPENEQHILQNTTFKDLFLYRHDICSLLITTLVNSYLGDNASVDSISNKLREVCPQLYKTEDAAFSKAVEILKMTRTIQNSDEKEEMIHSALQICKSIGPSINITDICREFTNLKAYKAITELCAHFGKKIDPNKIAESYYNSEDNSGDQEGYNYYQRRLEIYRHILNMLDTLYNEQSQTQSLSPNSDRACSTNQSILLDGVEQSQIGYVVKQVISDILETPDEIMHIALYDWLIFKNMTGDLINIQNTSLETYLKRTSVQNPNNVEAMDLLWKYYESCDNHAAAAKILNNLASRSGINVPLKERLSYLARAIMCMRSDKIGYAPYLGVFLRDLEDKMEVAKVQEQILNAITNLQGQIPNSQDAINALNSGLYEISQLYENFAEPFKLLECQLAIIECAGYTDQVLVESIWQQILTDELKKTFGTGTDKVCQLLNKVKQLAKQYAQSTNCFPLSYIVYELEIVNAKLKGDKQLVPTALESMNIPFESLINVYNSLNTISVNDHFWQLEENEFHLSEATSALINCFLSNHESYNSIEKRRITSLCQDTVVALLSNLYSKPNTETLVNKLRNIQARLSRI

SEQ ID NO: 12000 - protein, 1405 aa, Psylliodes chrysocephala
MTEFTLGYREVIPDQTVFENWREITLTTGGTQSTLQDIKVAERANGFCYEDSTKHHTRNRFIYWRINYDVLELVEHSLDVNLTANRVRYRFIDTPILDGVSIHETYENIIVLVPTVCSVHRLIFPHPDRFHRQDELLGIHPDLASPSIFSKASPVDARNPNTFYVFINPSTANDQLPNIASSYLLPETEEAFFILAYPSTELLLIKQNPDSGQVVCTELKGESLVPRFFAGIAEKFRQRNSDSDTIVSLLFYIVDYETYVLTLTRDAHLKFWSCSKGQCVAVIDVREKTADNSKDRVQGAILRKAVDGNSSESTLAVFLNFASGCQFHVLNPVIKGQEITIDRVATVYSPENDLIDFALQTNRLWSLWRSEDGDSVVYTASLPLCKQSGTFKSTSWTPVILETIPDANQAPANDGDSDSRQIYLQHIFHPGRFPLHIISKALSIYKRSTILSDAQISASALKQRICLAVDNEIQNMLNGENVNDDEYIDCADWCWQKFYSCCVQYHIASLKPLGLMLLPSVSGAVFLKKSAFSFLRPLDGLEHMTLCNEELYRDQFVNFSMLSEVLDLDAAEDVMNLFKVIVYLDQQISETFNQAFEKELFNLQAPDVVMDGLLEKIHSEMDSQFSSHILEMINDISDLYKAMHKVLELLRYESTLANPDNDINPAAMYHFSSLLGTSVVAESLRQQTKVRFLICRNLLLVCNVLLKEKTLDWGVLEAVRSVCMPDIVVLTQASFVVLWLSGLSTLVNMPVSESSLNRLNPLKLAPVLNLRPTSTCTSLLELFICSSGGQEARKSFARVSCSDEALAHWHLSLLPYLNHVRHIIWPISGGTVLAEWLLASGQHVWLQQYVRLLSNWCEWNSCTRNFLLATAFLTTGEFYKAEDLFETAAKGVFSDGFLQERILKGMDESPSKAFVNYYLKVIQLFELHKARDCVISVANTALSIVEPDDPLAATLYSIKFKHHLALKHYELAFDSLYSNPDAERKKDNLRDLVKTLLDEKKLDTLLNFTYGSMDEFFANILLTRARATDSVNNVFYDFLYSYQIKRGPLSYRLAASVMYEQAFRLNHANNIDALEKQVKCYLAAKNVLHLCQPEHAWVVRPADPDDEDEEVVLQPLAGSNREMRVFKLRKQVEVVDIETIQKELIFSSAKLKLARFNTSTPINITSPVELVTLLNTSGLFKTAFDICTTFSLAYSPVFETLTKQCVLLSEEDNPNAWNWLVENDLQDLPVNRESASDVIWQFLQDCLEKYEEPKMTTLHCVVAKKIINMRIYLPHWLVASYKMRNPSELLRLLHTSGRLEEAVELTNEYILSAMGYGKEFFGFTQPLAPTSPAFCLPVYAIQRLIDELNIQNVKNVERPFIQEYNNLKSLFTKYLETATRVSNQMCQTKLSSGSLKTNAPMIGIR

SEQ ID NO: 12001 - protein, 905 aa, Psylliodes chrysocephala
MEVSDENIQTLSRYLQETLNPDINVRRPAEKFLEGVEVNQNYPLLLLNLVHKPEADMTIRVAGAVAFKNYIKRNWFVEEDQTDRIHATDRLAIKNLIVTLMLSSPESIQKQLSDAISIIGKTDFPLKWPELITQMVEKFSTGDFNVINGVLRTAHSLFKKYRYEFKSNELWTEIKYVLQKIAQPLTDLLVATINLSQTHTNDVNALKVIYSSLVLICKVFYSLNFQDLPEFFEDNIQIWMTNFHTLLTVEVPSLQKNDSDEAGVIEQLKSQVCDNVALYAQKYDEEFQPYLPQFVTDVWSLLVATGLQPKYDLLVSNALQFLSSVAERNQYRHLFEDDNVLSSICEKVIIPNMEFRTSDEELFEDNPEEYTRRDIEGSDIDTRRRAACDLVNTLSQNFEKRIIEIFGQYLQVMLGKYTENPKQFWRSKDAALYLVTSLVSRGSTQKHGVTQTSQLVNITQFCQQHILPELERPDVNELPVLKADAIKYVMTFRSVLPSDLVVSTLPQLIRHIPSESAVVHTYAACTLEKILILRTNNQPIVTGAQLEPLATDLLRNLFGVLQQPVSEENEYIMKAMMRTFATLQERVIPFLGVALPKLTEKLQMVAKNPSKPHFNHYLFESFSLAIKIVCKANPGAVTSFEDILFPIFQGILQQDIQEFIPYVFQILSLLMENTPQGTIPEPYMQLLPCLLAPILWDRPANVSPLVRLLTAFATQAAPQIVAQDKLSGFLGVFQKLIASKSNDHEGFYLMQGLIQHLPMEALAPYHKQIFFLLFQRLSSSKTTKYVINLIVFFCLYMVKYSPNDLVSLIDGIQTQMFGMVLEKLLIAELQKIAGDVERKIVAIGVIKLLCECPEMYTGTYQKYWPQLLQVKKKTKYNTFKLPLFGSHPCYNIFPIGVTNILFPHL

SEQ ID NO: 12002 - protein, 315 aa, Psylliodes chrysocephala
MDQMLPSPGFSIPSIGTPLHQPEEDQLILPNALQQQQQQNQLPTSSSQVPPLAPMGGTTPTLGLGMGHAMSMPHTKYVTGFTLPMSSMTPQTPQHTMMSPMVNLGGSGPTGSGVTPTMGPSTPSPMTPMTPHSADPGIIPQLQNIVSTVNLSCKLDLKKIALHARNAEYNPKRFAAVIMRIREPRTTALIFSSGKMVCTGAKSEEDSRLAARKYARIIQKLGFPAKFLDFKIQNMVGSCDVKFPIRLEGLVLTHSSFSSYEPELFPGLIYRMVKPRIVLLIFVSGKVVLTGAKIRQEIYEAFDNIYPILKSFKKQ

SEQ ID NO: 12003 - protein, 158 aa, Psylliodes chrysocephala
MAAIRPMSRLLFSRSLQTTARRGYADQMNFTFAAGNQVFYNAMSVKQVDVPSFSGSFGILPAHVPTLAVLKPGVVTVYEDSGKVNKIFVSSGTVTINDDSSVQILAEEAHPVENLDVNAARDIRTKAQSQLSSAGTDQARAEAAIAIEVGEALVKAAE

SEQ ID NO: 12004 - protein, 327 aa, Psylliodes chrysocephala
MSGDGKQQEHFDTLFLSIAQHHPQGPTQLLDTFVNFLSRKTDFFTGAKEGEWEKLVLNTFKKYEKLSRENHEAELKEKREQEARKKAAAAKKAQAETVKPAQITELTEEEAAKLQAELDAKNNVSSASSSSTPVPTPPAPQKIEEDEDESEKGKLLPNKGNGCDLEKYTWTQNLGDIELRVPLNASFRVKQKDLIVNMTKKHLTCGIKGQPPIIDDDFLHEIKLEESSWVIEDGKMLLFTFEKVNKMNWWSKIVKSDPEISTKKINPEPSKLSDLDGETRGMVEKMMYDQRQKELGLPTSDEQKKQDVLKKFMEQHPEMDFSKCKFN

SEQ ID NO: 12005 - protein, 160 aa, Psylliodes chrysocephala
MIQSPSGVVHGYPGTSILQWSPDKKHSDRERWICIYPAYINSKKTIAQGRKINKEKCVENPTHQEIRDVLVAAGLKVGVENKLYSREKSKELLYRGRIRVQLKNDDNSLCNPNFPTRDSLMLHLGDMIPKLKSRLNKGSGDPQPQVTGSAKGKGKGKGRR

SEQ ID NO: 12006 - protein, 759 aa, Psylliodes chrysocephala
MMEDPEPTKRQKMPKVAKVKNKAPAEIQITAEQLLREAKERDLEILPPPPKQKISDPAELADYQLRRRKQFEDNIRKNRAVISNWIKYAQWEESQKEIQRARSIWERALDVDHRNITIWLKYTEMEMRNRQVNHARNLWDRATVLLPRVNQFWYKYTYMEEMLENVAGARAVFERWMDWQPDEQAWQTYINFELRYKEIDRARQIYERFVITHPEVKHWIKYARFEENHGFIHSARQIYERAVQFYGDDYMDEKLYIAFAKFEENQKEHDRARVVYKYALDHIPKDQTKELYKTYTIHEKKYGDRSGIEEVIMSKRKLQYEQEILQNPTNYDAWFDYLRLVEGEGDIDVTRETYERAIANIPPSKNKQFWRRYIYLWINYALFEELEAKDYERTRQVYKACLEVLPHKIFTFSKIWLLFAQFEIRQKNLTSARKILGMSIGMCPRDKLFRGYIDIEIQLREFDRCRKLYEKFLEFGPENCVTWMKFAELETLLGDADRARGIYELAINQTRLDMPELLWKAYIDFEISQDEPNNARRIYERLLERTSHVKVWLSYAKFELNNQTDDDLNIQLARRIFEKSNETLKNFPEKESRVLLLENWREFENAYGDDDSKEKVNAKMPRRIKKRQKVIDEDGVEQGWEEVFDYIFPEDEASRPNLKLLAAAKNWKKTADETEETIESRPAISTSSQRVREKLMASAKNWKNKQNETDNKENESERDNEDSQVHQEDEASKDVEQKEDTRSEDRDSKSEGEDGDESS

SEQ ID NO: 12007 - protein, 476 aa, Psylliodes chrysocephala
MGIKFLEVIKPFCSILPEIAKPERKIQFREKVLWTAITLFIFLVCCQIPLFGIMSSDSADPFYWIRVILASNRGTLMELGISPIVTSGLIMQLLAGAKIIEVGDTPKDRALFNGAQKLFGMVITVGQAIVYVMTGMYGDPAEIGAGVCLLIIIQLFVAGLIVLLLDELLQKGYGLGSGISLFIATNICETIIWKAFSPATVNTGRGTEFEGAVIALFHLLTTRQDKIRGLREAFYRQNLPNLMNLLSTVLVFAIVIYFQGFRVDLPIKSARYRGQHSSYPIKLFYTSNIPIILQSALVSNLYVISQMLAVKFHGNFLINLLGVWADVGGGGPARSYPIGGLCYYLSPPESVSHILEDPVHACLYIVFMLGSCAFFSKTWIEVSGSSAKDVAKQLKEQQMVMRGHRDNSMIHELNRYIPTAAAFGGLCIGALSVLADFLGAIGSGTGILLAVTIIYQYFEIFVKEQSEMGGMGALLF

SEQ ID NO: 12008 - protein, 161 aa, Psylliodes chrysocephala
MAMATSPSVDLSSYRDQHFKGTRAEQDKLLRLSTTLYVGNLSFYTTEEQIYELFTKCGDIRRIVMGLDKYKKTPCGFCFVEYYNREDAENCLRYINGTRLDDRIVRTDWDAGFLEGRQYGRGKTGGQVRDEYRTDYDSGRGGYGKIIQQKIGGLDTQGFLR

SEQ ID NO: 12009 - protein, 306 aa, Psylliodes chrysocephala
MAATVGRICGVGLLKPSNLTTISQKSSYSTAKDWTWGKKALLGSLGLVAGGTGAILFALDQSVKASDLELHPPKNIWSHTGLFSAFDHASIRRGYEVYKQVCAACHSMRFIAYRNLVGVSHTELEAKAEAEEQMVEDGPDDQGNMFKRPGKLSDYFPSPYPNEEAARAANNGAYPPDLSYIVSARHGGEDYIFALLTGYCDAPAGVVLREGQYYNPYFPGGAISMAQALYNEVIEYQDGTPPTASQIAKDVSTFLKWTAEPEHDDRKKMLIKAIGIFTFLIATCYYIKKLKFSSLKTRKIEFRPKE

SEQ ID NO: 12010 - protein, 571 aa, Psylliodes chrysocephala
MLSLLQYSGSSDEDGDTSLNTAKKSTSDPETKINPKYSFKSQLAVCAAPEVVPTGLDADQMHINLDTTELSYNPKFDVLFAPILGPVNPFKTQQQSVDRNMLSGHIEQAHVSEFQFENQRRTFTSYGYALDPSITNDGQIKVVGSTEEGKDVDSVKTVFETSKIRPLDKRKRKKNDDPGDVDGFLGPWGGFVDEQKVAKPTEEEQAELDEITSKKNKKGKPNEDKPIEEKSVLHIKDAVDYQGRSFLHAPQDVGVNLRSDSPPEKCFLPKSHIHTWTGHSKGIAAIRLFPRTGHLLLSAGMDCRIKIWEVYNERRCIRTYYGHRQAVRDINFNNSGKQFLSAGYDRYIKLWDTETGQVVSRFTSRKIPYCVKFNPDKNKQHLFVAGTSDKKIICWDTRSGDIVQEYDRHLGAVNSITFVDENRRFVTTSDDKSLRVWEWDIPVDMKYIADPTMHSMPSVTPAPNGKWLACQSMDNKIVIFSAMNRFKINRKKTFTGHMVAGYACSLDFSPDMSYITSGDADGKVYIWDWKSTKLFKKWKAHDNVCIGVLWHPHEPSKLISAGWDGLIKYWD

SEQ ID NO: 12011 - protein, 268 aa, Psylliodes chrysocephala
MVQKKPKKKVGKKVAAAPLAVKKVEPKKEVNPLFEKRPRNFGIGQDIQPPRDLSRFVKWPKYIRIQRQKAVLQKRLKVPPPINQFSQTIDKQTATQLFKVLEKYRPETALQKKNRLKAKAEAKVAKKEEAPTKRPNTLRAGTNTVTKLIEQKKAQLVVIAHDVDPIELVLFLPALCRKMGVPYCIVKGKARLGLLVRRKTCATVALTQVDSGDRSNFNKLLEVVKTNFNDRADEIRRHWGGGILGSKSAARIAKLERAKARELAQKQG

SEQ ID NO: 12012 - protein, 333 aa, Psylliodes chrysocephala
MATLIKDVTLQENIPTNILFEKHIDFIKEYGQKESSFEYGMTDYLRVSGMYWGLTALELMNASPPHSIEEILEYIKKCQDAETGGISACVNHDPHILHTLSAVQILCIYDSLKAIDVEGVVKYIKKLQLPDGSFMGDKWGEIDTRFSFCAVATLSLLNRMDAIDVNKAVDFVASCKNFDGGFGSRPLSESHAGLIYCCVGFLSVTNRLDIVDRDTLAWWLCERQLPSGGLNGRPEKLPDVCYSWWVLSSLTILGRLHWIDGNALKKFVLACQDTETGGFADRPGDIPDPFHTLFGITALSLLGHDTVQKVNPTYCMPQQVIDRLQLKPQVLGD

SEQ ID NO: 12013 - protein, 891 aa, Psylliodes chrysocephala
MNQETLQLIQILEKTVSPDKNELEQASSFLEQASQTNLLEFIKTLSDILRHGGNSPVARMAAGLQLKNQLTSKDPAIKLTYQQRWLLFSEEVRNYIKKNVVGALGTETNRPSSAAQCVAYIAVTELPQRQWPDLIATLVSNVCQGNSTEMQKEATLEAIGYICQEIDSDVLVTQSNDILTAIVHGMRSSEPSNHVRLAATQALLNSLEFTKANFDQPSERNYIMEVVCEATQSPDSQIKVAALQCLVKIMSLYYQHMEPYMAPALFPITLEAMKSENDAVALQGIEFWSNVSDEEVDLAIEDTEATEAGRPPTRVSRHYAKGALQYIIPILLQKLTKQEELDDEDDWNPSKAAGVCLMLLATCCEDEIVPHVLPFIKENIKSDNWRFRDASLMAFGSILGGLENNTLRPLVEQAMPTLIELMYDSSVIVRDTAAWTFGRICEIIPEAAINETFLKPLLESLITGLKAEPRVAANVCWAFSGLVEAAYEAADVNEETGAPDTYVLSQYFEFIIQRLLETTDRPDGAQANLRPAAYEALMEMVKNSPKDCYVTVQKTTMVILERLQQVLQMETHISSHNDRSQFNDLQSLLCGTLQSVLRKVTPEDAPHISDAIMTAMLTMFNSNSCKSGVIQGVQEDALMAVSTLVEVLGENFIKYMDAFKPFLYIGLKNHQEYQVCGTAVGLTGDIFRALKLKVLPYCDEIMTLLLENLRDQSVHRSVKPQILSVFGDIGLSIGSEFKKYLDVVLSTLAQASQAQVDRNDFDMVDYLNELREGVLDAYTGIIQGLKGDGPTPNPDVLILEPHIPFIVQFITVVAQDTEHSDGTVAVAAGIVGDMCTAFGAPMVQLLDLEPINEMLAQGRRSRVNRTKTLATWATKELKKLKLATTTAAAAS

SEQ ID NO: 12014 - protein, 416 aa, Psylliodes chrysocephala
METILEQQRRYHEEKERLIDAMVKEMLHKKNTYREAINSDHRQKYLLDRYMTSTERLIDLYEDKDGQRKAEVAALTGPNEFNEFYNRLKQIKDFYRRHPNEISVPMSVEFDEFAKARENPNEDMANFVEFTDEEGYGKYLDLHECYEKYINLKGIEKLDYITYLGMFDQLYDIPKERKTGEYRKYLLCLIEYLTWFVQRIRPLMDLDADLEEQIDQVLSNWDTGTVPGWPKETGSALTNVGAHLDLSAFSSWEELASLGLDRLKSALMALGLKCGGTLEERAQRLFSTKGKGSLDPSLMTKNSKNRITKEKEISRHRELGTLEAQIYRLADLVSAQRAATKENVQRKQARTDGERDDSENEESEDDSPDEGDDDVPYNPKNLPLGWDGKVSVHMGPTIFVRLILFFFIFHQYKYKM

SEQ ID NO: 12015 - protein, 212 aa, Psylliodes chrysocephala
MTIGKNNKMIQHINYRVRITLQDSRTFIGTFKAFDKHMNMILGDCEEFRKIKPKNSKVEREEKRVLGFVLLRGESIVSLTVEGPPPPEEGLPRVPIPGAAPGPGIGRAGGRGMPPGMTGVPVGLQGPVRGVGGPSQQVMTPGGRGQVSAPPQMNQGPPRMGGPPPGMMGPPPGMMGMPPQMGMGRGGPPPMGMRGPPPGMMRGGPPGPPRPY

SEQ ID NO: 12016 - protein, 429 aa, Psylliodes chrysocephala
MRDSVCEIPNHSRILPRYFWDTLLHISNKLQCGAVVIMNIEEYVMLWYISNKKKKLKRRRTLWVHPMVELREAKGTYNLLHQDLLQDTTKFFNYYRMSPQSFEELHNILKSELTKQDTTMRRSIQSRERLSITLRYIATGCSLTDLHYTYRVGISTASEIIQHTCKLIWTKMKEQCMPKPTRENWLEIAHGFFRNANFPHCVGTIDGKHIRVIKPQQSGSLYFNYKHFFSIQLLAMCDSNYCFTFVDIGDYGKNSDSSIFKNSDLYKKLSTKKLNLPDPDFLPEKDDCKIPYVIIGDEAFGLSFNVMRPYGGKFLPIQKRIYNYRLSRARRYIECTFGIFANKWRIFHRPLNVSIEFAEDIVKACTVLHNFVRIRDGYRHEDTLSYEGVYDNEVAATEAYPARPAIVIRDYFAEYFMTTHALPWQNNFI

SEQ ID NO: 12017 - protein, 5272 aa, Psylliodes chrysocephala; identical to SEQ ID NO: 11994

SEQ ID NO: 12018 - protein, 300 aa, Meligethes aeneus
SKYSDSSRRKDESSKYSDSSRRKDESSKYSDSSRRKDEKRSRSRSRNRHKKSKNRRDSHSSSSSDSSNSSSSSSSDNSLKLLEKLKEERLKQVDAKKKQKELLKATETAGEKRLRRLLKKQAKERSRKEKMGWDNEYLHYTNSDNPFGDGNLLSTFVWNKKLSKEGLTGVSHEELETRNRFKQEENKRELEKVKKRRLERELERQKREEEMGMLQRSKEAAQFEEWERQEDNFHLEQARLRSHIRIQDGRAKPIDLLAKYISAEEEVDAVEMHEPYTYLNGLHIKDLEDLVEDIKVYKEL

SEQ ID NO: 12019 - protein, 407 aa, Meligethes aeneus
MDNLEANIMDKSMRSVFVGNIPYEATEEKLKDIFGEVGQVLSFKLVFDRETGKPKGYGFCEYRDQETALSAMRNLNGYEIGGRNLRVDNACTEKSRMEMQNLLNQPPVENPYGEPIQAEKAPEAISKAVASLPPEQMFELMKQMKQTIQNNPTEARQMLLQNPQLAYALLQAQVVMKIIDPHSAVTLLHPSNQVPQTLMPGDKIPHIPINQSYATPLPTPVQAPRQDFQPVPPPIMHQNNQPVFTGQDVDLRSLDPRGGSDPRLTRGMGDQDMRTLPAPLANPLPPVGEGFNRDPRGSTASFPNDPRQQSQRVDPRQKNIPPPQMPPQPIRPPPQAVPAPPPVPSRAQISHAANSPNIGPAGASDQEKAALIMQVLQLSDEQIAMLPPEQRNSILVLKEQIAKSAHR

SEQ ID NO: 12020 - protein, 414 aa, Meligethes aeneus
AVYVDLPVIVGLLINLSNLILKMSQMEPEREKGLQDYRKKLLEHKEVESRLKEMREQLKDLTKQYDKSENDLKALQSMGQIVGEVLKQLTEEKFIVKATNGPRYVVGCRRQLDKAKLKAGTRVALDMTTLTIMRYLPREVDPLVYNMSHEDPGDVTYSAIGGLSEQIRELREVIELPLLNPELFMRVGITPPKGCLLYGPPGTGKTLLARAVASQLDANFLKVVSSAIVDKYIGESARLIREMFNYAKDHQPCIIFMDEIDAIGGRRFSEGTSADREIQRTLMELLNQMDGFDSLGQVKMIMATNRPDTLDPALLRPGRLDRKIEIPLPNEQARLEILKIHAGPIAKHGEIDYEAIVKLSDSFNGADLRNVCTEAGLFAIRSEREYVVQEDFMKAVRKVADNKKLESKLDYKPV

SEQ ID NO: 12021 - protein, 188 aa, Meligethes aeneus
DMVCSVAGITSDANVLTNELRLIGQRYLFQYGESIPCEQLVSWLCDVKQAYTQYGGKRPFGVSILYMGWDKHYGYQLYQSDPSGNYSGWKATCIGNNSAAAISSLKQEYKEGEMTLKDAKSLAVKVLSKTLDMTKLTSEKVEMSTLTRKDGKTFINILAGTEVEALISEFEKTEAAAAEASRKEKATA

SEQ ID NO: 12022 - protein, 891 aa, Meligethes aeneus
MSETKSETPKIESKKETEDDKNDLSEEDKQLQDELNLCVERLQENNAGLYMAALQALSSHIKASTTSMTSVPKPLKFMKPHYDTMKAIYEKITDAEVKKVCADIISVLAMTMGENRECLKFRLKSEMNKIGEWGHEYVRHLAGEIASEWAETDLTFDKGLRENLILLAKQIVPYNMAHNAEAEACDLLMEIERLDLLDEYVDDNIYPRVCLYLTSCVPYVADPENTTLLQTALLLFRKFKQYPQALRLAMQLNDHSLIEDIFITCPDTAVQKQLAYMLGRQQIYIEIPDTTPEYEDLIEIMANCHLNNHFLNLARELDIMEPKTPEDVYKSHLENSRPQFGGSQVDSARQNLAASFVNGFVNAAFGQDKLLMEDGNKWLYKNKEHGMLSATASLGLVLLWDVDGGLTPIDKYLYSSEDHIKSGALLACGIVNCGVRNECDPALALLSDYVLHQTNIMRIGAIVGLGLAYVGSNREAVLSLLFPVFSDPKSNMEVIGMAALACGMIAVGSANAQVTTTIMQTLMEKSETELKDTYARFLPLGLGLCHLGKQEGVDTIIAALEVIPEPFRSMATTMVDICAYAGTGNVLKVQHLLHICSEHYEAGDKEEARGNQDKNKDKTKEKEEKDKDLSSRQAIAVLGIALISMGEDIGGEMAYRTFGHLLRYCEPVIRRAVPLALGLISVSNPKLSILDTLSKFSHDSDAEVAHNAIFAMGLVGAGTNNARLAAMLRQLAQFHAKDPNNLFMVRIAQGLTHLGKGTLTLSPYHSDRQLMSPVAVAGLMATLVGFLDVKNIILGRSHYLLYTLAAAMQPRMLVTFDEDLNPLPVPVRVGLAVDVVGQAGKPKTITGFQTHTTPVLLAFGERAELATEEYLALTPIMEGFVILRKNPDFNP

SEQ ID NO: 12023 - protein, 329 aa, Meligethes aeneus
DLDSYNSERFAGNTVVTLVGNSETINELPTNVYVNLESVNGNMDYSANYIIPNNYDEYSIENSSSPQASYLLNRDPNMAAASIRYCTEPEGPYAGGAVVQNPGGHIAQYSGQQNYHISYAQNWTPQSQSASVYNGPGQMLAQADSTQFNGYANGGGSSGGLNEGAGTSSNPQELISPNSNRRSGVNCANCKTTNTTLWRRNNQGEPVCNACGLYFKLHGVVRPLSMKKEGIQTRKRRPKNTSSSGPSSSIVHHSSRLGTPAQHYTSPYPLPTEIQDGYELPHPMNYYNRVNTQSESYLRVTPHEEDSSVITSTSHHQNYQDQMDEEDGQ

SEQ ID NO: 12024 - protein, 1671 aa, Meligethes aeneus
IDQTRNKRKKSSFRKKDNKNAEIEQEVAPKLKPENPALKSNPLATTPITPGGNIVDMQGSISQETTEKDPTTINTNSEQSNLENSSPVDQQIEDEERLNSLKTSTEEIVEYQLKSPTNEKQDPDSLDAKQIEDTPDGYATSEANQEYVNQRGIRFTPQLQDEVTLLPYGLACVRELLRFLISLCNPLDKQNSDIMIHVGLTLLTCAFEVGSDSIGKYSTLLALVKDDLCRNLFSLLNTERLSVFAADLQVSFLMFESLRTHLKFQLERYLTKLMEIVMSDSPKVTYEHKEIALDNILQLWRVPGFVNELYLNYDCDMYCTNLYEDLTKLLAKNVLSATAGVYQTHLLSLDALLTVVDGIELHCRHKQDDSSNGSDFFNSSDGSLAAKRGRIRVSDRVPTIEELHAKKNIKKWLPQGTEYFNSKPKKGIQFLQEHNVLKHDLDINEIAMFLRENPALDKKTIGEYISNRNNLNILEAFVNTFDFTDTRIDEALRSYLETFRLPGEAPTISLILEHFSEHWHKSNGEPFADVDSAFTLAYAVIMLNVDQHNQNAKKQSLPMSAAAFKKNLKGVNGGNDFDGDMLDEIYNTIKNDEIVMPAEQTGLVKENYLWKVLLKKGQTKDGVYIHVNSGTYDSELFQLLYGPIVAALSFVFEKSEIPGSYKRILQGFEKCSFISAHYNLTRNLDMLLLSLSKFTMFHNQQRLNNITLQFGINNKAQLALKSVFSLTHQHGDSIRQGWKNVFDLILSLYCNNLLPKTYVEAEDFIEPSGKINLTFEEVESLQKQDTGLLSSLYSYMVSAENLSKIPSPEEQQCIDLAKECIKDCNLEQLVTDSKFLHEEALLELVGALMEQSRGPDVQKSLYNSYNENVTVFFLELLVKIVIQNRDRVVSIWRTVHDHLYTIVMNASVFDYQYLLERAVIGLLRVAIRLMRNEEMSPMVLQSLRMLLLLKSTTICRISRQISFGLYELLKTSAQNIHTNADWTIVFTLLECVGAGAQPPKPIAEDNQVDQGTKSDGENQLASDEEAAATSTDRGYTSDSELAKSPKHAAAQRSHSPPGVIAASPVGTPNTGGWILVGNEGEIQPVVGRTVPPTQYGLSLERNLGPHDPSSLIKCCESLAFLVRDVAHITPYNFDVCVHCIRTFVEASLHGCKHNKKSREGRPRRKNPNRKRQDLYKSRKSPTSSPEEEEEEASDDDALPTGYHQISIQLLDLMHTLHTRTAQIFKWWAEEGGEIAQETSLWTQGWCPLLQGIARLCCDVRKPVRMSAITYLQRALLVHDLQTLSGPEWEACFHRVLFPLLRYLLQPLTPKEPMAMEETRMRAATVLSKVFLHHLTPLLSLPTFFNLWLVILDFMEKYMHADKSDLLYEAIPESLKNMLLVMDSAKVFDAPDGHKSHLWAATWEKINTFLPRMKDDLFREINQGLAQEQMQLQQEIPTETVEITKPVQYNIENATRTSIILQPPTTGQQQVSSHLFAHLGQMVSTPIGPSYDAPAAPYRPLPPPVSIAPLVAPPLVSNSPLLPPNQTTPIIQPQPSYMSSFYAGAANSTSTAGHTFPVLCGNAAVLPPAAATEVQPVSLFTDYVVNPYNAASTDLNENAAAQIGGGGVSNNNGSTQNIFQSANYFQSGGNNIIPVGSEILYGIDATAPTNNTNNIPVVTATDNRDTSRSTEV

SEQ ID NO: 12025 - protein, 132 aa, Meligethes aeneus
YELKENRTMTPEVFGAMLSSMLYEKRFGPFFVEPVIAGLHPTTNEPFICNMDLIGCINQPDDFVVGGTASAQLYGMCEALWEPNLGPEDLFETTAQALINAFDRDAISGWGATVYIIEKDKVTVRDIKTRMD

SEQ ID NO: 12026 - protein, 936 aa, Meligethes aeneus
MEQKPAIDLVLLAVSSLYNNPNTTEKERASQWLGDLQKSVHAWTVADELLHHKRDLESCYFAAQTMRSKIQQSFHELPPEAHSSLRDSLLEHIAQINEQTNTIIVTQLCVALADLALQMPTWPRASLDLITKFSSTNMWPLLEILTVLPEELENRSVRLGENRRLDVLNDFKSCSTTILEFLKHCANTYTDNSQENVQVNIKILRCFTSWVSVGAFELSELGNNIVINRAFGILTYKPEGEKQTVGGALHSAATDCICTLLQCLEDNNNQQILETYLFNNVINLEVAYHMSVANEDQDKSINYCRVFTELAESFLEKIIMNSNNKSQHYAMKVLDLVLICVGHHDYEVAEITFNLWYVLSEDLYQKNNKEITEMFRPYVERLITALCRHCQMEPDHEGLLEDGDDFKDFRLKVSDLIKDVVFIVGSSSCFRQMFINLQTPGVTWESSEASLFVMQAVAKNIVPTENEVVPKVVEAILSLPETTHISVKYTSVLLLGELCEWIEKHANTLDPILNFLVCCLPQQGIGAAAAIALQNICATCNDHMPRHVPIMLQLLHQVDTFAITNNAVIGLLKGVASIIGCMNPPELTTALRELCSMQMNPICQLIEQDVVPVKGTKTDPVLWLDRLSSVLRHICCKNNQSDGPHPCKEVVLEIWPILSRTFDKYDSDLRIMERCCRSVRFMLRCVSQQVREILESLVGQIVRIYSHFKHSCFLYVGSILVDEYAADASCVQGLLDMLHAFIEPTFLVLQEENGLRMHPDTVDDFFRLCARFLQRAPVAFLQCPSLVHILQCALLASSLDHKEANMSVMKFFYDLINQAQTDRSKADYKQRKDLVHRVLEEYGQNLVNNLLHACVFYLHSYMLSEVADVFVQLLDFNRETTGKWLANGLDQLPVQSNGGIVTATPQQLKDIHASITRSDTSKSVTHALKELTRLYR

SEQ ID NO: 12027 - protein, 249 aa, Meligethes aeneus
DGFQVKRPGDKNVRCTILLLLDYQPLQFKLDPRLARLLGVHTQTRPVIISALWQYIKTHRLQDAHEREYIVCDKYLEQIFNCSRMKFAEIPSRLNPLLHPPDPIVINHVISVEGGAESKQTACYDIDVEVDDTLKTQMNNFLLSTASQQEIQGLDSKIHETVDTINQLKTNREFFLSFAKDPQQFIHKWIVSQTRDLKTMTDVVGNPEEERRADFFYQPWAQEAVCRYFYTKVQQKRAELEQALGFRNN

SEQ ID NO: 12028 - protein, 156 aa, Meligethes aeneus
INRFCCFLEFITMPKVRRSKKSPPEGWELIEPTLDELEQKMREAETETHEGKRKNESLWPIFKIHHQKSRYIFDLFYRRKAISRELYDYCLNENIADKNLIAKWKKQGYENLCCLRCIQTRDTNFGTNCICRVPKGKLEEGRIVECVHCGCRGCSG

SEQ ID NO: 12029 - protein, 354 aa, Meligethes aeneus
MNFVHSDVKTQGKKVSEENIWNTLEITKEKRSPPYHTDIIWVQNPLQQLINNELQRDMPAATLDILGSIQHPNNEECGIRDVWAHNLEDEFRTIRQIVQKYQYVAMDTEFPGVVARPIGEFRSSADYQYQMLRCNVDLLRIIQLGLTFLDDNGKTPGGSYTTWQFNFKFNLQEDMYAQDSIDLLTNSGIQFKKHEDEGIEPLEFAELLMTSGIVLMDNIKWLSFHSGYDFGYLIKLLTDNTLPQDENEFFDLLKLYFPTIYDVKYLMKSCKNLKGGLQEVAEQLDLERIGPQHQAGSDSLLTGMAFFKMKEMFFEDTIDDSKFSGHLYGLGTSFAVNGTSNNYATDNGDTTNSS

SEQ ID NO: 12030 - protein, 386 aa, Meligethes aeneus
EGIIESNWEEVVDNFDDMNLKEELLRGIYAYGFEKPSAIQQRAIIPCIKGHDVIAQAQSGTGKTATFSISILQQIDTYVRECQALILAPTRELAQQIQKVVIALGDFMSAQCHACIGGTNVREDMRKLETGVHVVVGTPGRVFDMITRRALRTSHIKMFVLDEADEMLSRGFKDQIHDVFRTLNSDVQVILLSATMPQDVLDVTKSFMRNPIRILVKKEELTLEGIKQFFVFVEREDWKLETLCDLYDTLSITQAVIFCNTRRKVDWLTENMHKKDFTVSAMHGDMEQRERDVIMRQFRTGSSRVLITTDLLARGIDVQQVSLVINYDLPSNRENYIHRIGRGGRFGRKGVAINFVTEEDKRTLKDIEQFYNTKIDEMPMNVADLI

SEQ ID NO: 12031 - protein, 223 aa, Meligethes aeneus
MTAPSAAGDASKGRNVAYKDKSKPGDVRSSNINAAKAVCDAIRTSLGPRGMDKMIQSANGEVTITNDGATILKQINVIHPAAKMLVELSRAQDVEAGDGTTTVVVIAGALLNAAEKLLSRGIHPTVISDNFQKAAVHAVNILNEISIPVVLKNRDQLLQSASTSLNSKVVSQQSSSLAPIAVDAVLKIVETGREQACNLSDIKVIKQLGGTTEDTELVDGLVF

SEQ ID NO: 12032 - protein, 409 aa, Meligethes aeneus
MEAMEVILPEKDEGSPSETKVSLQDADVEDLYTKYKKLQQMLEFLEVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLSADEKPDVQYSDIGGMDMQKQEIREAVELPLTHFELYKQIGIDPPRGVLMYGPPGCGKTMLAKAVAHHTTAAFIRVVGSEFVQKYLGEGPRMVRDVFRLAKENSPAIIFIDEIDAIATKRFDAQTGADREVQRILLELLNQMDGFDQTTNVKVIMATNRADTLDPALLRPGRLDRKIEFPLPDRRQKRLVFTTITSRMNLSEEVDLEDYVARPDRISGADINAICQEAGMHAVRENRYIVLPKDFEKGYKNNIKKDESEHEFYK

SEQ ID NO: 12033 - protein, 196 aa, Meligethes aeneus
VGLYRSCQWFIEAVVIFTNYVIYRVFFVYFNWNKMSKIKLQSSDGETFEVEIEIAKCSVTIKTMLEDLGMDEDEEEVVPLPNVNSAILRKVIQWATYHKDDPPPPEDDENKEKRTDDISSWDADFLKVDQGTLFELILAANYLDIKGLLDVTCKTVANMIKGKAPEEIRKTFNIKNDFTASEEEQVRKENEWCEEK

SEQ ID NO: 12034 - protein, 234 aa, Meligethes aeneus
MDEKASCKELDQWIEQLNDCKQLTENQVKTLCDKAKEILSKESNVQEVKCPVTVCGDVHGQFHDLMELFRIGGRSPDTNYLFMGDYVDRGYYSVETVTLLVALKVRYKERITILRGNHESRQITQVYGFYDECLRKYGNANVWKFFTDLFDYLPLTALVDSQIFCLHGGLSPSIDTLDHIRALDRLQEVPHEGPMCDLLWSDPDDRGGWGISPRGAGYTFGQDISETFNHSNGL

SEQ ID NO: 12035 - protein, 219 aa, Meligethes aeneus
YNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQ

SEQ ID NO: 12036 - protein, 480 aa, Meligethes aeneus
NDGATIMKLLDIVHPGAKTLVDIAKSQDAEVGDGTTSVVLLAGEYLKQIKPYAEEGVHPRIIIKAVRQSLQLCLEKINELSIKINKANPEEFRSLLEKCAATAMSSKLINQQRDFFSKMVVDAVLLLDTLLPLNMIGIKKVQGGGLEESLLVAGVAFKKTFSYAGFEMQPKVYKNCKIALLNIELELKAERDNAEIRVDNVREYQKIVDAEWNILYEKLRKVHESGANVVLSKLPIGDVATQYFADRDMFCAGRVPDEDMKRTLKACGGAVMTTAHDLKDAVLGRCDLFEERQIGGERFNFFNGCPNAKTCTLILRGGAEQFLEETERSLHDAIMIVRRTIKNDAIVAGGGAIEMELSKMLRDHSRTIAGKEQLLIGAIAKSMEIIPRQLCDNAGFDATNILNKLRQKHAQGHCWYGVDISKEDVSDNLDACVWEPAIIKINALTAATEATCLILSVDETIKNQKAGDAPQMGRGMGRPM

SEQ ID NO: 12037 - protein, 1575 aa, Meligethes aeneus
DPSASIIDFEVNIDGEWSPWSNKVPQIEVETHKVASPDIVVPTLDTVRHESLLYTWLAEHKPLVLCGPPGSGKTMTLFSALRALPDMEVVGLNFSSATTPELLLKTFDHYCEYRKTPNGVVLAPVQLGKWLVLFCDEINLPDMDNYGTQRVIMFLRQIVEQKGFYRASDQTWVSLERIQFVGACNPPTDPGRKPLSHRFLRHVPVVYVDYPGETSLKQIYGTFTRAMLRLTPGLRGYSEPLTNAMVEFYLASQDRFTQDMQPHYVYSPREMTRWVRGICEAIRPLDNLPVEGLVRLWAHEALRLFQDRLVEDTERRWTNENIDAVALKHFPSANCENALERPILYSNWLSKDYIPVDREQLREYVKARLKVFYEEELDVPLVLFDEVLDHVLRIDRIFRQPQGHLLLIGVSGAGKTTLSRFVAWMNGLSIFQIKVHNKYTAEDFDEDLRSVLRRSGCKDEKIAFILDESNMLDSSFLERMNTLLANGEVPGLFEGDEYTTLMTQCKEGAQREGLMLDSNDELYKWFTQQVMRNLHVVFTMNPSTDGLKDRAATSPALFNRCVLNWFGDWSDGALFQVGKEFTNRLDLDRPNWKSPDFFPAVCTHISATPVHREAVINACVYVHQTLHKANARLAKRGGRTMAITPRHYLDFIHHFVKLHNEKRSDLEEQQLHLNVGLSKIAETVEQVEEMQKSLAVKSQELQAKNEAANAKLKQMVKDQQEAEKKKVQSQEIQQQLAGQTIHIEQKRTEVMADLAQVEPAVIDAQTAVKSIKKQQLVEIRTMANPPAVVKLALESICLLLGENASDWKSIRTVIMRDNFINTVVNNFNTEDISDDVRDKMRSRYLSNPDYNFEKVNHASNACGPLVKWALAQIQYADMLKKVEPLREELNSLETQAETNQKRGDEVKSLIAQLEHSIASYKEEYAQLIAQAQAIKTDLENVQAKVDRSIALLKSLVIERERWEATSETFRSQMSTIIGDVLLSAAFIAYGGYFDQHYRQNLFTTWCQHLTQATIQYRPDIARTEYLSNPDERLRWQANALPTDDLCTENAIMLKRFNRYPLIIDPSGQATEYIMNEFKDKKITKTSFLDDSFRKNLESALRFGNPLLVQDVENYDPILNPVLNKELRRTGGRVLITLGDQDIDLSPSFVIFLSTRDPTVEFPPDICSRVTFVNFTVTRSSLQSQCLNQVLKAERPDIDAKRSDLLKLQGEFHLRLRQLEKSLLQALNDAKGKILDDDSVITTLETLKQEAAEIGQKVEETDKVISEIEMVSQQYMPLSQACSNTYFTMDSLNQVHFLYQYSLKMFLDMFSTVLLSNPQLDGVSDYQQRLNIITRDLLQVCYERVARGMIHNDRLTFALLLCRIHLKGVPSEPNLDQEFNFFLRGKEGVFTSSSTDSVDGLNNEQQEALTRLSLRLPAFKKLPEKIREMPEFGNWLQQSTPEQCVPGLWIEEKQLSPIGTSMYQLLVIQAFRPDRVIAAASLFVTAVLGVDFMPSAEKELDLAACVEKEIRSNVPALLCSVPGFDASSRVDDLAAEINKQISSIAIGSAEGFNQADRAINMACKTGRWGMLKNVPL

SEQ ID NO: 12038 - protein, 649 aa, Meligethes aeneus
EECKKSLPIFPFRDEFINAVRENQVLIIEGETGSGKTTQIPQYLHEAGFTEDSKKIGCTQPRRVAAMSVAARVAQEMRVKLGNEVGYAIRFEDCTSERTVIKYMTDGTLHREFLSEPDLQSYSVMIIDEAHERTLHTDILFGLVKDIARFRPDLKLLISSATLDAQKFSEFFDGAPIFRIPGRRFPVDIYYTKAPEADYIDACVVSVLQIHATQPLGDILVFLTGQEEIETCQELLTDRVRRLGSKVKELLILPVYANLPSDMQAKIFEPTPPGARKVVLATNIAETSLTIDNIIYVIDPGFAKQNHFNSRTGMESLMVVPISKASANQRAGRAGRVAAGKCFRLYTAWSYKHELEDNTVPEIQRINLGNAVLMLKALGINDLVHFDFLDPPPHETLVLALEQLYALGALNHHGELTKLGRRMAEFPVDPMMAKMILASEKYKCSEEIVSIGAMLSVNGAIFYRPKDKIIHADTARKNFNHPGGDHLSLLNVYNQWKDSDYSTQWCYENFIQYRSMKRARDVREQLVGLMQRVEIEMVSNVSETIDIRKSITAGYFYHIARLSKGGNYKTVKHNQSVTIHPNSALFEELPRWLLYHELVFTTKEFMRQVVEIESKWLLEVAPHYYKQKELEDPTNKKMPKTVGRSTRTE

SEQ ID NO: 12039 - protein, 456 aa, Meligethes aeneus
MKVEEVKSTVKTQRISAHSHIKGLGLDERGFAIQFAAGLVGQEQVREAAGIVVDMIKSKKMAGRAILLAGPPGTGKTAVALAIAQELGNKVPFCPMVGSEVFSSEIKKTEVLMENFRRAIGLRIRETKEVYEGEVSELTPVETENPAGGYGKTVSHVIIGLRTAKGSKQLKLDPSIYEALQKEKVEVGDVIYIEANSGAVKRQGRSDAYATEFDLEAEEYVPLPKGDVHKKKEVVQDVTLHDLDAANAKPQGGQDVLSMMGQLLKPKKTEITDKLRKEINKIVDKYIDQGIAELVPGVLFIDEVHMLDIETFTYLHRALESTIAPIVIFATNRGRCVIRGTDDIYSPHGIPLDLLDRLLIIRTKPYQRQEMEQILKLRASTEGLEIEAEALSILGEVGVKATLRFAVQLLTPAFLTAKINGRANITKADVEEVSTLFLDAKASAVILSENQSKFMK

SEQ ID NO: 12040 - protein, 731 aa, Meligethes aeneus
MTSIIKLTAVSGAMDESPPCYILQVDDVRILLDCGWDEKFDMEFIKEVKRHIHTIDAVLISYPDVFHLGALPYLVGKLGLNCPIYSTIPVYKMGQMFMYDLYQSHYNMKEFDIFSLDDVDATFEKIIQLKYNQSVPLKGKGYGLTITPLPAGHMIGGTIWKIMKVGEEDIIYANDFNHKKERHLNGCELEKLQRPSLLITDAYNASYQQARRRARDEKLMTNILQTLRNNGNVLIAVDTAGRVLELAHMLDQLWRNKESGLLAYSLALCNNVSYNVVEFAKSQIEWMSDKLMRNFEGARNNPFQFKHLQLCHSLHELAKVSSPKVVLASSADMESGYSRELFLQWCSNPNNSLIITSRTSPGTLARELVDNGGNREIEMNVEKRVKLEGAELEEYEKKMKELRNVKKESDNESDSDDDIEMSVISKGRHDIVIKQEGKVSGGFFKVTKKQYPMYPFSEEKIKCDEYGEIIKPEDYKLADVVPEEDNKENIVIKKEEEDITEIPEIPTKCIILNRTVQVNCQVQYIDFEGRSDGESLMKILSQLRPRRVVIVRGSPENTKVIENHCTDILHTRVFVPSKGDTIDATSETHIYQVRLTDALVSQLNFQKAKDAEVAWINAQIVLRESQLDAKRMTIDNEPMEEEDDFNVLTLEPYPGEIPHDPVFINELKLSDFKQVLGKNSIPSEFSGGVLWCSSGTIALRKVENGRIMIEGCISEDYYKVRELLYEQYAVL

SEQ ID NO: 12041 - protein, 780 aa, Meligethes aeneus
SIDVVICQNLRSSESKRLIFCVAFKEKLIKMPPLEPNGEKNDEPGPINSVVGIIYPPPEVRNIVDKTASFVARNGPEFEARIRQNELGNPKFNFLNSGDPYHAYYQHKVNDFREGKGQEPATNLPAAISKLSVTASAQQKQQEILKQVEQPFVPKDPPQEFEFIADPPSISALDLDIVKLTAQFVARNGRQFLTQLMNREQRNFQFDFLRPQHSLFQYFTKLLEQYTKVLIPPKSMQQRLRDEAKSARSVLEQVKYRAEWQRYQEQQKAKEEEILERERVAYAQIDWHDFVVVETVDYQPFEIGNFPPPTTPEEVGARLLIQERIEEGEDIEMQLESDDEESAPPTDEGLSHMQDRTHGRKGRDDNRVQDMEEDSSDEDSRGPSKPSQPSIQPPMPPIPDKVVVKKYDPKQAVKVTRPTVGDDFLVSPITGEKIPASKVQEHMRIGLLDPRWVEQRDKQVMDKMNQETVYAAGSAIDASLKLLAERRTDIFGVGDEETAIGKKIGEEDVRKDERVTWDGHTSSVEAATRAARANITLEEQIHQIHKVKGLLPDEEKEKIGPKNVMGQSKNAKGNKGQQMQNQQKPPQMPPMPTQPTIQLQVAPQPIIAPQPQIMMMPAPPMAQMRPPPLMMAAPPPMGGFVTQLPPQMAPPMNMPHKHPNEGPLEEEPSNKKMRNEDSLVPEEVFLARNPSPVSIKVAIPVIPDKPEWKLTGQMVSYTLPLSESVSNLKVKIQEETNMAPAKQKLFFDGMFFKDSNTLAYYNITQGAVIQLQVKTRGGKK

SEQ ID NO: 12042 - protein, 336 aa, Meligethes aeneus
EVVIVAICQIYLLKMPSQEVTTTKVVVHPLVLLSVVDHFNRMGKIGNQKRVVGVLLGCWRAKGVLDVSNSFAVPFDEDDKDKSVWFLDHDYLENMYGMFKKVNARERVVGWYHTGPKLNQNDIQINELIRRYCPNSVLVIIDAKPKDLGLPTEAYQAVEEVHDDGSPTSKTFEHVPSEIGAEEAEEVGVEHLLRDIKDTTVGTLSQRITNQLLGVKGLHCQLREIRDYLIQVSEEKLPINHQIIYQLQDIFNLLPDINQENFNKAFYVKNNDQMLVVYLAAMVRSIVALHNLINNKLTNKDAEEGKKEEAKKDKDSKDKEKEKEKDKDAKKDEKKK

SEQ ID NO: 12043 - protein, 175 aa, Meligethes aeneus
MFGGGRAPIVVLSNNTKRESGRKVQLENINAGKQIADVIRTCLGPQAMLKMLMDPMGGIVMTNDGNAILREITVQHPAAKSMIEIARTQDEEVGDGTTSVIVLAGEMLVAAEQFLEQQMHPTVIIREYKKALEDIVTLLEGPLSVPVDRNDKAAVAQVVRGCIGTKFISKWGDLA

SEQ ID NO: 12044 - protein, 235 aa, Meligethes aeneus
MSLSMEGIRPHYPDYSNAPMQRHFSPYADNGGSVVAIAGDDFVVIGADTRLSAGFSIYTRDQNKLFPLSKTTVLGCAGCWCDTLTLTRILTSRMQMYQQEHNKTMSTVACAQMLSTMLYYKRFFPYYISNVLVGLDNEGKGCVYSYDPIGHCEKATYKAGGSAGALLQPLLDNQIGLKNMEIIGDSKLTIEKATNIIKDVFISAAERDIYTGDSVIINIITKEGIKDDKFELRKD

SEQ ID NO: 12045 - protein, 300 aa, Meligethes aeneus
MFQFGFNMFPELPRPFNVTYKCYSVAMLPGNERQDVERGGKIIMPPSALEQLTRLNINYPMLFKLVNKKTNRTTHCGVLEFVADEGKVYLPLWMMHNMVLDEGDFVQMESVSLPVGTFSKFQPLSPEFLDITNPKAVLENCLRSFACLTSGDIIAVKYNSKVYELCVLETKPGDAISIIECDMNVEFEAPVGYKEPEHVKKEDEDMQIDPSELMPEPAGFIAFKGAGNRLDGKKRKDSTSSDSTMLPTKTAYVRGIPDYDYEIGTLKFIRRNFKPASKESAENIDFKAFSGNGFSLKGRK

SEQ ID NO: 12046 - protein, 222 aa, Meligethes aeneus
EDTVLVRGVVIDKTMSHSQMPKELKNVKMAILTCPFEPPKPKTKHKLDVTSVEEFKELRQYEQDKFKEMVDLVKKAGANLAICQWGFDDEANHLLYSQGLPAVRWVGGPEIELIAIATGGRIVPRFEELTPDKLGSAGLVRELAFGTTKDKMLVIEDCSNSRAVTILVRGGNQMLVAEAKRSLHDALCVVRSLVLEPRVVYGGGAAEIACSLAVAAEADQLA

SEQ ID NO: 12047 - protein, 112 aa, Meligethes aeneus
MASAMDVDVDEVEMPTSSSKGEKKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 12048 - protein, 227 aa, Meligethes aeneus
MDTDKIKVFGSHIKVDSMAKIAELESAEKEKMKEKVDKILKHKPTVFINRQLIYNYPEQLFADAGVMAIEHADFDGIERLALVTGGEIASMFDNPGDIKLGTCDLIEQIMIGEDILLRFSGVALGEACTVVIRGATQQIIDEADRSIHDALCVLAATVKESRVVYGGGCSETLMACAVRKAAASTPGKEAVAMEAYARALLQLPTIIADNAGYDSAQLVSELVAAHN

SEQ ID NO: 12049 - protein, 278 aa, Meligethes aeneus
MFRNQYDSDVTVWSPQGRLHQVEYAMEAVNLGSATVGLKSKTHAVLIALKRASSELSAYQKKVINIDEHIGITISGLTADARILSRYMRTECLNYKYSHDTVLPLNRLISTLGNKMQVCTQRYDRRPYGVGLLVAGFDDKGAHIYQTCPSANYYDCKAMSIGARSQSARTYLEKKIDELHNAPLEDLIKHGLRALRDTLPPEVDLNTKNVSIGFVGDKQPFKILDEDETAPFLALIEGEERRGGGGGPPDAAAAPLRDEAGDQDAPREPVPQVAMDTD

SEQ ID NO: 12050 - protein, 849 aa, Meligethes aeneus
MPIKNADEPMEIVFTDDDLPYEEEILRNPYSVKHWLRYIDHKKKSPKHGVNIIYERALKELPGSYKLWYNYLRTRRKQVKPRCLTDPLYEEVNNAFERALVFMHKMPRIWMDYCTFLTDQGKISRTRKVFDRALRALPVTQHHRIWPLYLGFIKKHDIPETAVRVFRRYLKLSPENAEEYVEYLTEIGRLDESSLVLAKIVNDENFFSQQGKSKHQLWNELCELISKNPDEVRSLNVDAIIRGGLRRYTDQLGHLWNSLANYYVRSGLFDRARDIYEEAIQTVSTVRDFTQVFDAYAQFEELSLSKRMEEIAKLSSPSEGDDIDLELRLARFENLMERRLLLLNSVLLRQNPHNVQEWHKRVQLYEGKPHEIINTYTEAVQTVDPKLAVGKLHTLWVEFAKFYESNVQIDDARLIFEKGTQVPYVKVDDLANVWCEWTEMEIRNENYDDALKLMHKATVMPAKKVAYHDDTESVQARLYKSLKVWSMYADLEESFGTYKSCKAVYDRIIDLKIATPQIIINYGVFLEENNYFEEAFRAYEKGISLFKWPNVYDIWNTYLTKFLKRYGGSKLERARDLFEQCLENCPAQFAKTLYLLYAKLEEEHGMARHAMAVYERATNAVLPEEMFEVFNIYIKRAAEIYGIPKTRQIYEKAIEVLPEDRTREMCIRFSDMETKLGEIDRARAIYAHCSQICDPRVTTEFWQIWKEFEVRHGNEDTMREMLRIKRSIQAMYNTQVNMMSAQMLSSSSSVSGTVADLAPGVKDGMRLLEAKAVEMTGSSAGSRPGNIMFVRGETQGNHKDKVINPDEIDIGNEDDEDNDDEKEAEEIPVEKQSIPLEVFGSLKNKSKEN

SEQ ID NO: 12051 - protein, 382 aa, Meligethes aeneus
MANGPIAERNRDATIYVGGLDDKVSESLLWELFVQAGPLVNVHMPKDRVTMMHQGYGFVEFMGEEDADYAIKIMNMIKLYGKPIRVNKASAHQKNLDVGANIFIGNLDAEVDEKLLYDTFSAFGVILQTPKIMRDPETGNSKGFAFINFASFEASDASIEAMNGQYLCNRPISVSYAFKKDSKGERHGSAAERLLAAQNPLSQADRPHQLFADAPPMGMMPPGMSMAPPPPPVLIMPPPPPTPTNMQPPPPPPVPPPAAFPSGIPPPPLPPSQPPLPPGAPPLPPMAGAGIPPSGRPPLPPMPPTSTRALQPPWQAGGIPPPPPGPPSGAGPVPPFPGMFPPPPPPGGRPPPPNWRPPPPNFVGRPPFPPRGPPPPPPSFEG

SEQ ID NO: 12052 - protein, 257 aa, Meligethes aeneus
MGRVIRAQRKGAGSVFKSHTKKRKGAPKLRYLDFSERHGYIKGVVKEIIHDPGRGAPLAMVNFRDPYKFQTRKELFIAPEGMYTGQFVYCGKKANLQIGNVLPIGAMPEGTIVCNLEEKTGDRGRLARASGNYATVIAHNHDTKKTRVKLPSGAKKVIPSNNRAMVGIVAGGGRIDKPILKAGRAYHKYKVKRNCWPKVRGVCMNPVEHPHGGGNHQHIGKASTVKRGTSAGRKVGLIAARRTGRIRGGKVETKKED

SEQ ID NO: 12053 - protein, 136 aa, Meligethes aeneus [sequence omitted]

SEQ ID NO: 12054 - protein, 262 aa, Meligethes aeneus
HDALLGQHVQAHGVDALLVDHREALVGAGAELLLELDHLAHALHDEVALRRHHLLALLGRFVEEARVHFALLVLHAHVAGEDVRVFQLFGHVGVAAPVVHHDTFDQRSVSFSFVLHLHQLNHVQVDGFVALLDGQNPVDAHLGQNVGQLPVHLGPQAGLAHVHQALSGRLDGDLDLLQDLQRLGSGFVEALGQDPRVQTFGYVDVGLLEELADHQDGGGGAVACHVVLRGGSPGYQGGGRVLDLHLVQQDVAVLGDFDVARA

SEQ ID NO: 12055 - protein, 912 aa, Meligethes aeneus
MSSAEIVDSSVDPPAKKRKLELSSFSSDMANNGAEGSSQAGDIDEGLYSRQLYVLGHDAMRRMASSDVLISGLGGLGVEIAKNVILGGVKSVTLHDEAVCTISDLSSQFYFNESDVGKNRAKACCKSLSELNTYVPTTAYTGKLDESYILKFRVIVLTTSSLKEQLLISKITHSNNIALIIADTRGLFAQVFCDFGESFTVVDINGEPPVSAMVADISSEKEAIVTCIDDTRHGMEDGDYITFSEVKGITELNNCNPIKIKVLGPYTFVIGDTTKFSKYEHGGIATQVKMPKVVNFKSLTESLENPDFIISDFAKFDSPTQLHLAFQALHEFIETHSRTPTPWSPSDASEFLNIAKSINKQNIEIDSKLLELFSKISSGDLNPMNATIGGIVAQEVMKACSGKFHPIYQWLYFDAIECLESDEPEEITEELAEPIGSRYDGQIAVFGKNFQKAIGELKYFVVGAGAIGCELLKNFAMVGLGTQGGEITVTDMDLIEKSNLNRQFLFRPHDVQQSKSVTAAKVIKKMNPDVNIAAHENRVGVDTENVYDDKFFESLDGVANALDNVDARMYMDRRCVYYRKPLLESGTLGTKGNTQVVVPFLTESYSSSQDPPEKSIPICTLKHFPNAIEHTLQWARETFEGLFKQNAENASLYLKDPEFVERTLKLPGVQPLDTLQSVKAALIDERPKSFEDCIHWARLHWQEQYSNQIKQLLFNFPPTQLTSTGQLFWSGPKRCPDPLEFDVNNSLHLDYIVAASNLKAQVYGIQTNRDRMYISQIVTQVEVPEFVPKSGVKISVTDFQMGMSNGSNVDLDRVSQIREELPPAPEFGTLRLMPIEFEKDDDSNFHMDFIVAASNLRATNYKIVPADRHKSKLIAGKIIPAIATTTSVVAGGGGFLLFLFLIKKKKKKKKKK

SEQ ID NO: 12056 - protein, 425 aa, Meligethes aeneus
MADADDLLDYEDEEQTEQTTTETAGAGDAKKAVKGTYVSIHSSGFRDFLLKPEILRAIVDCGFEHPSEVQHECIPQAVLGMDILCQAKSGMGKTAVFVLATLQQLEPTENVVYVLVMCHTRELAFQISKEYERFSKYMSNIKVGVFFGGLPIQKDEELLKNNCPHIVVGTPGRILALVRSKKLNLKHLKHFILDECDKMLELLDMRRDVQEIYRNTPHGKQVMMFSATLSKEIRPVCKKFMQDPMEVYVDDEAKLTLHGLQQHYVKLKENEKNKKLFELLDVLEFNQVVIFVKSVQRCVALAQLLTEQNFPAIGIHRGMDQKERLSRYEQFKDFQKRILVATNLFGRGMDIERVNIVFNYDMPEDSDTYLHRVARAGRFGTKGLAITFVSEESDAKILNEVQDRFDVNITELPDEIDLSSYIEGR

SEQ ID NO: 12057 - protein, 259 aa, Meligethes aeneus
PPGLEGGDSKRDTDIQGVMEIREQARQIEKAVANKENRFILRVLRCLPNTRRKLNGIVLRSLISQIYPLSEREALLSFVEEAVGSEIDSQTRARSATKTPVSEVDLYIHLIILVRLIDTNKLEEALRCSQALMGKITSQNRRTSDHIAAKCYFYHSRVAELTDKLDTIRAFLHARLRTATLRNDFEGQAVLINCLLRNYLHYSLYDQSDKLVSKCVFPETASNNEWARFLYYLGRIKAARLEYSVAHKHLVQAMRKSPQ

SEQ ID NO: 12058 - protein, 554 aa, Meligethes aeneus
MASAPQNLPVSEILKSKAEFEDEPKKKSREDWRKAKELEEARKAGTAPAAVDEEGKDINPHIPQYISSAPWYYGTSGPTLKHQRPQEEKQKQFSKIDEWYSRGVDNSKIVTKYRKGACENCGALTHIRRDCMERPRKVGAKYSGANIAADEFVQKNLALSFDGKRDRWSGYDPSEHKAVIEEFQKVEEAKRQLKADKLDANEDSEEEGEKDEDKYVDEVDMPGTKVDSKQRITVRNLRIREDTAKYLRNLDPNSAYYDPKTRSMRENPNPSKDDPYSGENFVRFTGDTTKHLNAQLFAWDAYEKGVDVHLLAEPTKLELLQKEYEQKKEQFKGKIQNNILEKYGGEEHLDAPPKTLLLAQTEDYVEYSRSGKIVKGQEKEIIKSKYEEDVYINNHTSVWGSFWKGGHWGYKCCHSFIKNSYCLGENGKNKNSTESIPLVEESTKDEEEKEESPEEKEASSSNEEDSKLKKEKRKKKKDKKKKQKEKKQNKKKDLLKEAVKAEEQSQENADRLLAIDERKRPYNSMFEAKKPTEEEIEAYYLKRRREEDPMNQFM

SEQ ID NO: 12059 - protein, 174 aa, Meligethes aeneus
TKLGGPRRIHPVRTRGGNLKYRALRLDTGNFAWGSEGTARKTRIIDVVYNASNNELVRTKTLVKNAIVVIDATPFRQWYENHYILPLGRKKGAKLTADEEAILSKKRSKKVQKKYETRQKTSKVEPAIEEQFQTGRLLACLASRPGQCGRADGYVLEGKELEFYMRKIKSKKAK

SEQ ID NO: 12060 - protein, 111 aa, Meligethes aeneus
GFGCWLSGVDINTQQSFEALSERAVAVVVDPIQSVKGKVVIDAFRLINPNMMVLGQEPRQTTSNLGHLQKPSVQALIHGLNRHYYSISINYRKNELEQKMLLNLHKKSWMD

SEQ ID NO: 12061 - protein, 404 aa, Meligethes aeneus
MTVINKMDIDGPPKGEGFRSYYITKIEELQLIVAEKSQNLRRLQAQRNELNAKVRMLREELMLLQEQGSYVGEVVKPMDKKKVLVKVHPEGKFVVDIDKNIDINDVTPNCRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 12062 - protein, 199 aa, Meligethes aeneus
MVKLYCLSVLHKGPTTATWLKSAFELQSFSFFQRGSVQEFMSFFCKTIVERTIPASRQSVNEGEYLCHVYVRGDNLAGVVITDHEYPSRVSHTLITKILDEFSVKFPVESWPQLQERDVAFPQLNTYLAKYQNPSEADAMTKIQEDLDETKIILHNTITAVLQRGEKLDDLVSKSEGLSIQSKAFYKTARKTNSCCSFS

SEQ ID NO: 12063 - protein, 146 aa, Meligethes aeneus
HIGCAVSGLMADSRTMIDRARIECQNHWFVYNENMSVESCAQAVSNLAIQFGDSDDDGAAMSRPFGVAILFAGIDEKGPQLYHMDPSGTFVQFDAKAIGSGSEGAQQSLQEVYHRSMTLAEATTSALTILKQVMEEKLNSSNVEVM

SEQ ID NO: 12064 - protein, 385 aa, Meligethes aeneus
MTEYWLISAPGDKTCQQTWDKMNTATSKQNSLSLNYKFHIPDLKVGTLDQLVGLSDDLGKLDAFVEQVTRKVASYLGEVLEDQRDKLQENLMANNTDLPSYLTRFQWDIAKYPIKQSLRNIADIISKQVGQIDTDLKTKSTAYNNLKSSLQNMEKKQTGSLLTRNLADLVKREHFILDSEYLTTLLVIVPKSSFNEWNATYEKITDMIVPRSTNLIIQDAEYGLYTVSLFKKVVDEFKLHSREKKFIVRDFTYNEEELAAGKNEITKLVTDKKKQFGPLVRWLKVNFSECFCAWIHVKALRVFVESVLRYGLPVNFQAILIHPNKKTMKRLRDVLHQLYGHLDSSAALSGVNVDSVDIPGLGFGQSEYYPYVYYKINVDMIDSKV

SEQ ID NO: 12065 - protein, 268 aa, Meligethes aeneus
HHHGFRLQHALHDAQGVVHRTLHLVAVEVVGAAQDYRGRGAGLWLFNNDQLIIADSLLGYFGRFTNHTAVESFITVHVGQGCEISGSGGFGDALEVDLLDPANGHGVLLDEILEAEVVDAAGNQDDVHARRQDLLDALLRHVQLAVPDALQLVRVADQDLHAQLHLGLLQRKVQARDLRVGDLLGHGLAGDGAVQRVTLHQDALPRTSAVRLEDVDRLDGVHGLAFRVLDLDRLSGVHDHGREQIGIGADDFRAHRGFGHVYQALAPQ

SEQ ID NO: 12066 - protein, 257 aa, Meligethes aeneus
MFDPTSNPPPFWQNGPAPGAFYNFPNTKSGPSDEFQHSQAPITTATSIVAIKYATGVIIAGDLLGSYGSLARYRNCPRVLQVNENIILGAGGDYGDFQYIKNFIEQKIVQEECLDDGFKLKPKSLYCWLTRVMYSCRSKFDPLWNNLVIGGIQDGEPFLGTVDKLGTAFTDKIICTGYGAHIAVPLLREAMEKNPNMSKDEAKALVEKSMEVLFYRDARSFPKYQVAIIDQNEGSVIEGPLVVKQNWSLAHMISGYN

SEQ ID NO: 12067 - protein, 691 aa, Meligethes aeneus
PTLTLLASTEFQPEKYVKDLSQNYVGGSELQAIRKKIQALSEDTNNNLKKNVYQNYGQFIDTAKEISHLESEMYQLSHLLSEQKSLLNSLASTSLMGDNSNLTRNKERSEEKIIEEQKQKTQSILEKVEGCKDVLDIPGRTFLHEGDLLELDSLENKPIKPVHVYLFNDGFMITSRNSNSRGLMKYKFEVMYELGSLAVVNVRDLGDVKHAFKLLIFPETRIFQCSSNSNKKDWLDKFDQAKKNQLSQDVQRRESIIERSPSRTTIESGIHSTLSESEDDLVIITHPEWFLDLPEELDVGVAQRHFEEAITLLQKGKDYMSQLGLPNAKTDHVLIDIQRKLDMRQSSLTEVLMKELEINPDKSLQGGLRAARRAVRLLNQLGRSTQSCDLFLKLCSSMLKIQCKRVKREGSTTTYIRHLSSVVFTNMCHMTDEFLRAFPESSVCASAYIVWASSELSSFSAHFIKQVFVPQTSLATITECVFLVKTQCERLCNYGIDLCYQLDGALLTPLTKALTDTRDKLIDSVKVRALEDKWIPTNFHTKNGLSRCLNEHREMGLQLDSYVTGDIWLQLTQNTIAFTKVFLALLECCLRLKTTELLYTVDTVLYEIYGAQLKHYELTLKKDLQKEERQFIIKNTEFLLVTLYNLIQRKYTKSNGFECKTFAKVQIDYAALMKICLGNRNIKTKYSSEFL

SEQ ID NO: 12068 - protein, 1202 aa, Meligethes aeneus
MNEVEKLEYLSLVSKVCTELENHLGMNDKDLAEFIIHLSETHDTVSSFKKVLIENGAEFSDSFVSNLLRIIQHMRPRKSGQNSSKASSQPDADKNDLAFKFPGLALPNESQKPMEEEKKPADKPKEKKEDNDVVADLMAQFEAQAPSSNKEGDRKRERSRSKERDRHREGDRSKRNRSRSRSREHHRDRRNRSRDRDRSRRHRSRSRERRRSRDRRSRSRERKHDKHDRVNNKNKHERSPELDDDPVPGKIYSGKVANIVPFGCFVQIEGLKRRWEGLVHISQLRAEGRVTNVSEVTARGNKVKVKILSVTGQKVSLSMKDVCQMSGKDLNPLSHAPSEREDRDRNPDRPTSSSTSVFRLPVGTDEGEEDSRKKITKMSSPERWEIKQMISSGCIDKSELPEFDDETGLLPKDEDGEADIEIELVEDEAPFLHGHGRAMHDLSPVRIVKNPDGSLAQAAMMQSALAKERREQKMLQREAEVDSQPSGKNKNWIDPLPEEEDKPSQARGIGLQTQDLPEWKKHVIGGKKSSFGKKTNLTIVEQRQSLPIYKLKEELRKAVTDNQILIVIGETGSGKTTQITQYLAEAGFIARGKIGCTQPRRVAAMSVAKRVAEEFGCRLGQEVGYTIRFEDCTSPETIIKYMTDGMLLRECLMDLDLKGYSVIMLDEAHERTIHTDVLFGLLKQAVQKRPELKLIVTSATLDAVKFSQYFFEAPIFTIPGRTFPVEVLYTKEPETDYLDASLITVMQIHLREPPGDVLIFLTGQEEIDTACEILYERMKSLGPDVPELIILPVYSALPSEMQTRIFDPAPPGSRKVVIATNIAETSLTIDGIFYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLSKMLIMSVALQCSDEILTIVSMLSVQNVFYRPKDKQALADQKKAKFNQPEGDHLTLLAVYNSWKNNKFSNAWCYENFVQIRTLKRAQDVRKQLLGIMDRHKLDVVSADRNTVRVQKAICSGFFRNAAKKDPQEGYRTLVDSQVVYIHPSSALFNRQPEWVIYHELVQTTKEYMREVTTIDPKWLVEFAPAFFKFSDPTKLSKFKKNQRLEPLYNKYEEPNAWRISRVRRRRN

SEQ ID NO: 12069 - protein, 420 aa, Meligethes aeneus
MAPTRKHIDDILARVNFPLYTIQMLSNRHVLVGGGGGSSKTGVANGFEIFEIAHDGKKFIAEEVTRHETGPSVVMNCSSYSNSKHSYLVAGQESHCQLYSVDSVLVRDEDNVENVGENHTEVRQRKAKPKEQTDNNRNVKKRLKFNIKPMDSVQTDFNGQEPLLRVMRIGHNGKMLATGGTDNTIKLWKFPNLEPLATLKAHEKEIDDIDFSHHGNFLITVAKDGLAVLWDSLKGKELNRLEWKQPEGSKYLYKRCRFGLIEGLDEKRSALYMLANPTGVARKQKSYLQQWLAEGGHLKNSIEFDESLSALAVRDDGRFVAVGTMFSGSVSIHAAFSLQKVLNISGAHSMFVTGLEFLPVSQDNHTATSVAEAAVLSISVDNHVCIHTLPFRKTMPAWIGILILVCTLFMTFVFCSYLRI

SEQ ID NO: 12070 - protein, 438 aa, Meligethes aeneus
FQNFRCLFKSKSDVHNDVWLTNMAGAMLFERAQSVSSHHDKLLENLKREQEERDDEENIKNKEQDILNLGEKYKKEGKAKELAELIKATRPFLGEISKAKAAKLVRSLVDFFLDLEAGIGIEVQLCKECIEWAKEERRTFLRQSLEARLIALYFDTGMFAEALLLGSTLLKELKKLDDKNLLVEVQLLESKTYHALSNLPKARAALTSARTTANAIYCPPKMQAALDLQSGILHAADEKDFKTAYSYFYEAFEGFDSVESPKALTALKYMLLSKIMLNNPEDVQQIVSGKLAIKYAGRDIDAMKAVAQASHKRSLADFQQGVKQFKHELEDDVIVRAHLGTLYDNMLEQNLCRIIEPYSRVQVDYVAKTIKLPMPQVEKKLSQMILDAKFHGILDQGEGVLIVFEETPVDKTYEMALETIQSMSKVVDTLYQKAKKLS

SEQ ID NO: 12071 - protein, 233 aa, Meligethes aeneus
MSSKSKKTSTPASQMPQRPASPLSPTRHSRLQEKHDLQNLNDRLASYIDKVRYLEQENSRLTREVQTSQECTTREITNIKSMYDVELSDARKLLDETHREKARLEIDVKRLLEENDELRDDLARKSKDLMIADNSARINETKANEMQLKYTQANQDAKKAINDARNLEKERDKLRKLLDEHRKHLEEESLARVEIENANQSLREELSFKDQIHQQILTETRTRRQVELSEIDG

SEQ ID NO: 12072 - protein, 622 aa, Meligethes aeneus
EGAPTKREGEEEALTAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSESALQQIREKMDLIDLEDDQIDAEVLNSLAVTMENFRYAMTKSSPSALRETVVEVPNVSWEDIGGLQNVKKELQELVQYPVEHPDKFLKFGMQPSRGVLFYGPPGCGKTLLAKAIANECQANFISIKGPELLTMWFGESEANVRDIFDKARSAAPCVLFFDELDSIAKSRGGNVGDAGGAADRVINQILTEMDGMGAKKNVFIIGATNRPDIIDPAILRPGRLDQLIYIPLPDDKSREAIFKANLRKSPVAKDVDMNYIAKVTHGFSGADLTEICQRACKLAIRQCIESEIRRERERATNPNVASMEVEEDDPVPEITKAHFEEAMRFARRSVSDNDIRKYEMFAQTLQQSRGFGTNFRFPNAGTGPQAPGGTAGDQGNFQDDPEDDLYS

SEQ ID NO: 12073 - protein, 274 aa, Meligethes aeneus
MGDQFDCALDLMRRLPPQQIEKNLCDLIDLVPSLCEDLLSSVDQPLKVAKDKDSGKDYLLCDYNRDGDSYRSPWSNTYYPPLDDGSMPSERLRKLELDANHAFDQYREMYFEGGVSSVYFWDLDHGFAGVILIKKTGDGSKKIKGCWDSLHVVEVQEKSSGRNSHYKMTSTAMLWLQTNKQESGTMNLGGSLTRQMEQDSVVSESNPHIANIGRMVEDMENKIRNTLNEIYFSKTKDIVNSLRSVQPLNESRQQQALKQDLAAALQRRHNKSDN

SEQ ID NO: 12074 - protein, 1372 aa, Meligethes aeneus
MQQVMAPTLNNMGANMNDTREAPPRNDTPVDPINGVVQPLVNPAPERPGRVTNQLQFLQKTVLKAVSKHQFAWPFAAPVDAKKLNLPDYHKIIKQPMDLGTIKKRLDNNYYWSGKECIQDFNTMFSNCYVYNKPGEDVVVMAQTLEKVFLTKVADIPKDEVVVEPPAKGGKGKKGRTSSGSGTGGATPTAGRGRPPGAVSSTSATPVATTTGSSGLPLGTQAPTTVPGSTATTTITPASTHSSLPPQPISQNYHSNSLDPLSTSVLPGSVVPPSQPAKSKKGVKRKADTTTPTANAYDYNPPLESKSAKIINRRESGRQIKKPIRPELDGLVPYNQATISPMTNMNTATPQHAALKTKEKLSEALKACNEILKELFSKKHSSYGWPFYQPVDAQLLGLHDYHDIIRKPMDLGTVKQKMDNREYRTAQEFAGDVRLIFTNCYKYNPSDHDVVAMARKLQDVFEVKFAKIPEEPVNRIGGPPVKSESSSSGSSSESSSETEDSEEERRNKQLKSLEKELIMMQEKMRKLVEESSKRKKEKKKQKEKEKPKKTVANNNSSSGNSNNSIGKGAHGGMINKSNSVVDSVDDSIASVVSGADLKIVGGDAHHATSGKSLAAHHNAGANAAAAPTTKSAKSKGVRGPKPSSVASGFPAANRSNRAAKPASKAGRKKQQAAPAPLAFDSEDEDNAKPMSYDEKRQLSLDINKLPGDKLGKVVHIIQSREPSLRDSNPDEIEIDFETLKPSTLRELESYVASCLRKKPHKKVQGKSKDEQMAEKKQELEKRLLDVNDKIGTKKAPKKEEANKVDPTGAGGPSGRLSSSSSSSDSDSSSSSLSSSSSDSSDSEAGTGKGQPKKKAKKSPNPAGNTTSIQKPPILPPQPAQPTAAPPTNNTTNLPVASNNSEVPPPSSTSSSISSTQSQNSNHAASNNKFITNPSPMPSVASRKPSVEKPPVSLASQNIAPPTAPQVPKPVALPTPSPDKPKPNILSPLSSAYTDPLEQSLARLEHDIAKSEPMEVKSEALDLPGNLLPMPPVLSNPMLNPNINSNPNLHHALQPNLGMDMKQPIGMMPMMPPNLQMLGMHNPLENDIASLMQNSHPPYMMHSQNNGIGMKNEYDMHTNNNGISSMGLPMELSIPTMFDSLPLQMNNSGMRKDQNPPKMDERMDLGHMGMSNDKKSHNMDSHKQHSQSFAAGYKPNKPDHNVKNASSWSSLGSNLGKGSSPQSNSQGGSSKQTVMESFKAFQNKAKEKADREKQRLENLEMKRLQREQAEKERIRAENERRREREEEDALEKARKAVAEQQQQQPIPVQRVEELRSSPGEGSISPGSQSSGSEKTERERQRLQEQERRRKEAMANKIDLNMQSDLMAAFEGSL

SEQ ID NO: 12075 - protein, 185 aa, Meligethes aeneus
EMTKTKQAVQFLRRIKAWSDIQKVYKSQRFRAGKGKMRNRRRIQRKGPLVVYHQDQGLRRAFRNIPGIDLISVGKLNLLKLAPGGHVGRFVIWTESAFQRLDKLFGTWKTPSGEKKGYNLPQPKMANTDLSRLLKADEIKQVLRAPQKKIVRRQRRLNPISNTRAMLRLNPYAAVLKRQAILSGQ

SEQ ID NO: 12076 - protein, 1088 aa, Meligethes aeneus
MSDFIQSEAEESEDEDLTTHERKKLKKVKAMDSSEEEDDDDDRLREDLKDLIDDRPIEESDGEESDGSNGEKRKKSDDEEFDDRLEDDDYDLIEENLGVKVERKKFKRLRRIQDEESDNEEEQGEGQDRDQIALKLFDDDDDERRSERSHRTTVEPDQFGEEEDEGEYSDADDFIVDDDGRPIAEKKKKKKPIFSDAALQEAQETFGVDFDYDEFSKYEQDEYEDDEDEEDDDYEEDDDGERRRPPKKERRKKPTKKSIFEVYEPSELKRGFFTDLDNEIRNKDVPERMQLRDVPITPVADDSTELDDEAEWIYKHAFCKPSVSNMEANLTSEQREKLKKGPQTVTKIRKALDFMRNQQLEVPFIAFYRKEYVQPELNINDLWKVYKFDSKWCQLKSRKENLMKLFDKMRSYQLDELMKNPDAPIPDTVRVMKDSDMERLKNVQSAEELNDVHNHFALYYAGDLAAMHAAWRLKEKERRRQERNEERMRRIAESEDGADIPEEPEEEVDDEPEEHLKYANRSGSYKLCSRAGLDTLAKKFGLTPEHFAENMRDNYQRHEVEQEFTEPTEVAKEFISAKFSTIEEVIQAAKYMVALQIAREPLVRKCVREVFFERAKISIKPTKKGQKVIDEAHNCYSLKYVKNKPVRDLAGDQFLKLTMAEEENLLTITINETIEGNTSNSYIDEVKQLYIRDEFSKNVQDWNALRVECVERALTRCIVPDLRVELKRILLAEAKEFVLKACCRKLYNYIKVSPYEIEFPDEDEDEWNTNKGIRTMGLAYVPDYGQSAFACISSPDGEITDYLRLPHLLKRKNSYRQEEKMMKEADLTAMRNFIFTKKPHVICVGGESREALMIAEDLRGVISDLIESEQFPCIKVEIIDNELAKVYANSNKGTADFRDYPELLRQAISLARKMQDPLIEYSQLCNGDEEILSLRFHPLQEQIPKEELLEALCLEFVNRTNEVGVDINLAVQQNHKVNLVQFICGLGPRKGQALIRVLKQTNQRLENRTQLVTACHMGPKVFINCSGFIKIDTNSLGDSTEAYVEILDGSRVHPETYEWARKMAVDALEYDDDEGANPAGGGGGGGGG

SEQ ID NO: 12077 - protein, 798 aa, Meligethes aeneus
MTTDSERGSPTAAAPRRSASKSPEPKKAKYDKKEKGDKDRKRRSHRSRSRSRDRDHRDKHGGKKRYHDLDDPSEDYPRYYGEDRKQNSDRYWSKYPKKDRDEYVIGSRYYDVEEKKEKKEKEDENKDKSVITPRERKTVDLLTSRTGGAYIPPAKLRMMQAEITDKSSAAYQRIAWEALKKSIHGYINKINTSNIGLIARELLHENIVRGRGLLCKSIIQAQAASPTFTNVYAALVAVINSKFPNIGELLLKRLVLQFKRGFKQNNKSICISAATFVAHLVNQRVAHEILALEILTLLVESPTDDSVEVAISFLKESGQKLTEVSSKGINAIFEMLRNILHEGQLEKRIQYMIEVMFQVRKDGFKDHAAVTEELDIVEEEDQFTHLITLDDVKQANSEDILNVFKFDDKYEENEGKYKTLSKEILQSDSESGESGSEGSEEDSEDEEGEEDETKNQTIIDNTETNLITLRRTIYLTIQSSLDFEECAHKLMKMEIKPGQEIELCHMFLDCCAEQRTYEKFFGLLSQRFCQINKTFIEPFQQIFKDTYSTTHRLDANRLRNVSKFFAHLLFTDAIGWEVLDIMKLNEEDTNSSSRIFIKILFQELSEYMGLAKLNKRLKDETLQEYFAGLFPRDNPKNTRFAINFFTSIGLGGLTDELREHLKNVPKHLEVMALKADSSSSSSSSSSSSNDSSSSSDSSDDEGSRKKKTKKLKTPDKKKKQKEDEKPKKKSEDKPRNKPDYRDRRNDDREKFKKYRNNDEESHRRSREDAREKYRGHEERRSDHREEYRPREHRGRDRR

SEQ ID NO: 12078 - protein, 586 aa, Meligethes aeneus
MALKGQVGQKIMNEVIKHKPKKNGPAHGVEWRVLVVDQLAMRMVSACCKMHDISAEGITLVEDINKKREPLNTMEAIYLITPSEKSVHSLMNDFESPRLMYKGAHVFFTEACPDNLFQKLSQHPVVKYIKTCKEINIAFIPNESQVFSLDCPETFQCSYDPAMEAARNANMERMAEQIATLCATLGEYPSVRYRSDWERNVELAQMIQQKLDAYKADEPTMGEGPEKARSQLLILDRGFDCVSPMLHELTFQAMAYDLLPIENDVYKYEASAGVFKEVLLDENDELWVELRHQHIAVVSQSVTKNLKKFTDSKRMTQSDKQSMKDLSQMIKKMPQYQKELSKYATHLHLAEDCMKSYQGYVDKLCKVEQDLAMGTDAEGEKIKDHMRNIVPILLDPKITNEYDKMRIIALYAMIKNGITDENLSKLATHAQIKDKQTIANLQFLGVNVINDGGNRKKPYSVPRKERITEQTYQMSRWTPVIKDIMEDAIEDKLDQKHFPFLAGRAQTSAYHAPTSARYGHWHKDKAQQTVKNVPRIIVFIVGGMSFSEIRCAYEVTNAQKNWEVIIGSSNILTPQSFLKDLNTLTV

SEQ ID NO: 12079 - protein, 712 aa, Meligethes aeneus
MMQQYMKELEQEPFDPDEFIERLAWRTMSEVKSDGEDFNPNILHDSFVQAIKDLTLLQEHQQKKCKKLEAIVRENEAQFFGDVAKLTTDNKQSMETFQELDGKITHVASKVLHLGDQLDSVNGPRARVVEAQKLMTHLNEFFTTGPLTSSLFTDPKRVDEAADVIQKLFVISQDLPNEKFSGVLEKIKRKYADIERSLIEEFTDELKRDNVDRMKEIASVMYQFKGYSRLINEYIEYSQAGCLHTKEIFYSQLLELCRKNYERIKEVFINPDQVMSKFVLNIYQLKIQEHIRLRLSDKLETYNYLKTLYELLSKTNQLSNDLAMVHVSSDKNFLNKLTSNIFSKYIDNYIQLELKCLRGRCSTNLQRYYDSKNHQKKQIQSGGFQDLRRDIQAVIGTRANINIAQIENYGGETFLSEELAITVLQDTKHAFQRCQLLSKPEDRASNATQILDYLINCLLTEHVDYALELGLQAIPVVEAARTPPVIYFFSVVYQSNNITHLLEKQFSDLVVPLVINSVKYNDCLQKKKFVLEDIEKKVNNGIDRSLNAIAAWIKMYLQAEQKKSDFKPETDDFDTVASPACKLVSQYITSMIKEIKSNLDGNNVTIILQELGIRLHRVVYDHLLQFQYNTAGAMVAICDLNEYRSCTKPLGLLVQELFETLHALCNLLLVKPENLAQVCSEDSLVNLDKSVLNNFIQLRSDFKAQKQNILKV

SEQ ID NO: 12080 - protein, 270 aa, Meligethes aeneus
MDFQNRPGGKTGGGGVASWSETNRDRRERLRQLALETIDLQKDPYFMKNHLGSYECKLCLTLHNNEGSYLAHTQGKKHQANLARRAAKEAKDAPSLIQPEKPRVEPKKFVKIGRPGYRVTKQRDIENGQQSLLFQIDYPEIGDMVIPRHRFMSAYEQKIEPPDRKWQYLLFAAEPYETIGFKVPSREVEKTDTKFWTHWNRDTKQFFLQFAFKNEAKKSTTIITRPGHIIAGVPPPPMMPVPPPPRPPMFNPLPPPPPMMGGVMPVPPPH

SEQ ID NO: 12081 - protein, 134 aa, Meligethes aeneus
MSIGVPIKVLHEAEGHIVTCETITGEVYRGKLIEAEDNMNCQMTQITVTYRDGRVAQLENVYIRGSKIRFLILPDMLKNAPMFKKQTKAGTAGRGKSAILRAQARGRGRGQPPIRGRGGAPWQAPQGGAPGRGR

SEQ ID NO: 12082 - protein, 463 aa, Meligethes aeneus
GEFGWHPCKFTTGILTTGLKVSTKMATNLTKAPLLRKAATRGYSKLAPVSGIPNYEVKTSTLPNKTVVVAADNDSQIARVSIILRAGSRNETAENLGITHLLRNCAGLSTKNASQFIITRNIQQVGASLTATSDRETISYTLEGTRSAVEKVIPYFTEVATQQVFKPWEVAENTGRLHLDIATRPLQVRAIDLLHKAAFRTGLGNSMFIPKFHIGKISSESLQHYVCENFTSGRAAVVGLGMDEAEVTKIAQSLHLGSGEGQTRPSPYKGGEVRSDKGGDLAFVAIAGEGASLANAKEALAFAVLQRAIGTGPQVKWSARDNGLLSKAVGNAEFASSAINANYSDTGLFGVLVAVPAKNASSVVQSTYKFMKCINVSEEDVSRGKNQLKTALLLEGENGANAIENLATQAVLTGTAHSATSLAALVDSISASDVQQAANKVRSGKLSVASVGNLTGVPYMDEL

SEQ ID NO: 12083 - protein, 110 aa, Meligethes aeneus
MRRAHAGYGYEPLSQNSNEIEDENDRMTNELKDKIGVLKSLSIDIGNEVRYQDKLLNDVDDDLERTGGFLGNTMNRVMRLTRGGHNYYIIYMFLFSIFVFFVLYLVLKFR

SEQ ID NO: 12084 - protein, 228 aa, Meligethes aeneus
MVKMTTLSPRQAQREHVLAVSRDFVSQPRLTYKTVSGVNGPLVILEDVKFPKFYEIVQLKLADGSIRSGQVLEVSGSKAVVQVFEGTSGIDAKHTVCEFTGDILRTSVSEDMLGRVFNGSGKPIDKGPPILAEDFLDIQGQPINPWSRIYPEEMIQTGITAIDVMNSIARGQKIPIFSAAGLPHNEIAAQICRQAGLVKVPGKSVLDDHEDNFAIVFAAMGVNMETAR

SEQ ID NO: 12085 - protein, 228 aa, Meligethes aeneus
MSRNQSGNRLQVPNDLREVLLEFTISYLLEQPGDVVAYAADYFQRLRETRTTSLIYGGSGTQDLMSPDESTISGEEEPPIERFTSRRKSVFAETYDPEEDDDDDDGIKTVFPKSDEQRQRLSEAVRNILLFRSLDKEQMSEVLDAMFERKVQQDELVIKQGDDGDNFYVIQSGIFHALVASEPAQVPTHIHTYDNAGSFGELALLYNMPRAATIKAVTTGSLWAMDRQ

SEQ ID NO: 12086 - protein, 807 aa, Meligethes aeneus
MSYMQANQNRPMGQQGHYQQGPNDLPMPSSKEQTLMWQQNSYMGDSGIHSGAATQVPSLTGKEDEEMDLFDLDQGYGQGFTQDQVDEMNNQLNQTRSQRVRAAMFPETLEEGIEIPSTQFDPGHQTAVQRLAEPSQMLKHAVVNLINYQDDADLATRAIPELIKLLNDEDQVVVSQAAMMVHQLSKKEASRHAIMNSPQMVAALVRAISNSNDLETTKGAVGTLHKLSHHRQGLLAIFKSGGIPALVKLLSSPVESVLFYAITTLHNLLLHQDGSKMAVRLAGGLQKMVALLQRNNVKFLAIVTDCLQILAYGNQESKLIILASQGPIELVRIMRSYDYEKLLWTTSRVLKVLSVCSSNKPAIVEAGGMQALAMHLTNASARLVQNCLWTLRNLSDAATKVDGLEALLQSLVTVLGSQDVNVVTCAAGILSNLTCNNQRNKVTVCQVGGVDALVRTIVNAGDREEITEPAVCALRHLTSRHVESEMAQNAVRLNYGVQVIVKLLNPPSRWPLMKAVIGLIRNLALCPANHAPLREHGAIHHLVQLLMRAFQDTQRRASVASGGSNQPGTYADGVRMEEIIEGTVGALHILARESHNRAIIRQQMVVPIFVGLLFNDIENIQRVAAGVLCELAADKEGAEMIEQEGATSPLTELLHSRNEGVATYAAAVLFRMSEDKPQDYKKRLSMELTNSLFREENLWNPDLGIGSELQEILSPEHYDNLYPQDPPSVHSSHGSRPYQQQGYDQIPIDMQGLEIGSHGGGNGSTYSAIDAMEVTSGEPDLNFDGIDQLPTPPQDNNQVAAWYDTDL

SEQ ID NO: 12087 - protein, 268 aa, Meligethes aeneus
MARNAEKAMTTLARWRAAQLGESEKHKKRRPYLASECKSLYACEKWRMQIIREIAKKVAQIQNAGLGEFRIRDLNDEINKLLREKRHWEDQIKELGGPDYQRVGPRMLDHEGKEVPGNRGYKYFGAAKELPGVRELFEQEPPPPPRKTRAELMKDIDADYYGYMDDDDGILLPLETKAEKTSIQKKVAEWKEKKENRLNKASDDEDDEEDENIYAVEESDEEEQPQVIDGSQQRFVAHVPVPSQQEVEQALLRRRKQELLDKYGAHED

SEQ ID NO: 12088 - protein, 215 aa, Meligethes aeneus
MAQEQEMPSFKCVLVGDGGTGKTTFVKRHLTGEFEKKYVATLGVEVHPLVFHTNRGAIRFNVWDTAGQEKFGGLRDGYYIQGQCAIIMFDVTSRVTYKNVPNWHRDLVRVCENIPIVLCGNKVDIKDRKVKAKSIVFHRKKNLQYYDISAKSNYNFEKPFLWLARKLIGDPNLELVAAPALVPPEVQMDPHWQQQIEKDLKEAQETALPEDDEDL

SEQ ID NO: 12089 - protein, 159 aa, Meligethes aeneus
MTSAITVGTLIIKLVKLVLNFIIIIMYRVGFQGYFLGVGGTWNLNEEKNADAEIVASGIFVGYIIYTVVSLISFCFAAGDHKTTFTDVLMNVVGVFMWVAVGATALHYWHGYLAEHKYTAINSERQVGLVMGSLCIINGAAYLVDSALSIIFLLQTKLA

SEQ ID NO: 12090 - protein, 823 aa, Meligethes aeneus
MPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEEGEDGADDPRKLKPGEIDPNPETKPARPDPKDMDEDELEMLSEARARLANTQGKKAKRKAREKQLEEARRLAALQKRRELRAAGIEVNSRRKKKRGVDYNAEIPFEKRPAIGFYDTSSEALDPMAPDFSKMRQQHLDGELRSEQEERERKKDKAKLKQRKENDIPQAMLQNQEPAKKRSKLVLPEPQISDQELHQVVKLGRASEVAKEVAAESGVETTDALLNDYTVTPQAAATPRTPAPQTDRILQEAQNMMALTHVDTPLKGGLNTPLHNPDFSGSLPQALAVATPNTVLATPFRSTRSDGGATPGSTGFMTPKSGAVVPVGGTIPGNFTPSVRDKLNINAEEGIEVGGTPAKNRMFQTSLKEQLKMGLSSLPQPKNDYEIVVPEQEDEKMPEHAQEHMVEDQADVDQRYQEELKAKAERELALRSQVIQREFPRPHDVNLAVLRPPHESYSLTDLQKAEELIKTEMVTMLHYDNLKNPIPTTTTKRSNLSQAQQLAFLEQHPYENYKPEDLDVAKVLLKREMDVVKHGMNHGELPLDAYTQVWEECLGQVLFLPNQNRYTRANLASKKDRLESAEKRLEQNRSHMAKEAKKAAKMEKKLKILTGGYQSRAQVLIKQLHDLFDNIDQANLELNTFKFLQEQEKSALPRRIQSLTEDVNRQMEREKALQHKYGELQFQMKEIQDQYSQIHLEVNGIQENQENMVEESTEVE

SEQ ID NO: 12091 - protein, 156 aa, Meligethes aeneus
MQFMLLFSRQGKLRLQKWYNAHPDKLKKKITRELITTILARKPKMCSFLEWRDLKIVYKRYASLYFCCAIEQDDNELLTLEIIHRYVELLDKYFGSVCELDIIFNFEKAYFILDELLLGGEIQETSKKNVLKAIAAQDLLQEEETPQGFFDDHGLG

SEQ ID NO: 12092 - protein, 271 aa, Meligethes aeneus
MHRLNYALLRCSITKSHNGLRLYSKEQRRQTFISRLYDNFRDEMAKNKEMKESLKKFREEAQKLEQSDALKAARHKFETVEKEASEGSKVFKEKFDSIKEKVQGVVDEVGKSDIAKKAGKISEGIGKTTTSFTEKAQEIGKTSAFQSISQTAEAVKKEIDTTSMEGRVYVSPTKLRKRTETSAVQNVKFYEPNEEATGIELHKDSKFYQSWQSFKDNNPYVHKVMDWKLKYDESDNPLIRASRVLTEKVSDVVGGLFSKTELSETLTEICK

SEQ ID NO: 12093 - protein, 260 aa, Meligethes aeneus
SDSDVELQEALADGRLKPGLNIVDQKPKQFVNNTTGLNQKLEEIKSSLPWIELLDCVNKQAPLAPEMAAQMLEQEQKRENQLKNNKKLQQFAPTDDPVLNDFKREMMFHRQAQAAVQEAIPKLKAMDIATKRPDDYFAEMAKTDAHMQKIREHLMQKQQQQQRSERVKQLRTQRKEGKMIQIQTKLQRQQEKKEMMDQVKKVRKGLSKDLDFLDGKKNKAISRKSLEKRKMRDKKFGFGGKKKGMKMNTKESAADISEYK

SEQ ID NO: 12094 - protein, 1202 aa, Meligethes aeneus; identical to SEQ ID NO: 12068

SEQ ID NO: 12095 - protein, 502 aa, Meligethes aeneus
MNPSAPNYPMASLYVGDLHSDITEAMLFEKFSTAGPVLSIRVCRDLITRRSLGYAYVNFQQPVDAERALDTMNFDVIKGRPIRIMWSQRDPSLRKSGVGNVFIKNLDRSIDNKAMYDTFSAFGTILSCKVAQDENGTSKGYGFVHFETEEAANKSIEKVNGMLLNSKKVYVGRFIPRKEREKELGEKAKLFTNVYVKNFGEDLTEEQLRIMFEKYGVITSYKIMSKDDGKSKGFGFVAFESPEAAETAVEALNAGKELVEGKPLYVGRAQKKAERQQELKRRFEALKMERLNRYQGVNLYVKNLDDTIDDERLRKEFSPFGTITSAKVMMEEGRSKGFGFVCFSSPEEATKAVTEMNGRIVGTKPLYVALAQRKEDRKAHLTSQYMQRMANMRMHQMGQFIQPGSSGYFVPTIPAPQRFYAAAQMNQIRTSPRWPAQTQVRAGGGQGGAAAYAGGQGQGGMPSGGGGGYRAAARPPNNQSAAMRGNMNVPRPITGGQQQPGG

SEQ ID NO: 12096 - protein, 946 aa, Meligethes aeneus
FVCQKQEAFANITSITKKIKDFRYHGKMTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSGLVEDQGFLEQLKELLSDSNPMVVANAVAALSEINESSPTGQPLVELSTSTINKLLTALNECTEWGQVFILDSLSNYTPRDEREAQSICERITPRLAHANAAVVLSAVKVLIKMMEILAGDVEFCNTLSKKLAPPLVTLLSSEPEVQYVALRNINLIVQKKPDILKHEMKVFFVKYNDPIYVKLEKLDIMIRLASQANIAQVLSELKEYATEVDVDFVRKAVRAIGRCAIKVEPSAERCVSTLLDLIQTKVNYVVQEAIVVIKDIFRKYPNKYESIISTLCENLDTLDEPEARASMVWIIGEYAERIDNADELLDSFLEGFADENAQVQLQLLTAVVKLFLKRPQHTQGLVQHVLSLATQDSDNPDLRDRGFIYWRLLSTDPAAAKEVVLADKPLISEETDLLEPTLLDELICHISSLASVYHKPPTAFVEGRSAGIRKTLPARQGSADEIGQEATVIPNQESIVGDLLSMDLGATAPAAPLGGPAATSNIDLLGGGLDVLLGGGSSDISTAGGAAPSTTGLLGDIFGISSSPSMYTPPKTCWLPAEKGKGMEIHGTFSRKNGQMSMDMTFTNKAMQAMSGFAVQFNKNSFGVSPSGPITMTPLQPGQSLEYSLPLNTTGPVQRMDPLTTLQVAIKNNVDVFYFACQMPIQILFTEDGTLDKRVFLTTWRDIPSANEVQYTINDLNGNTDTVSNKMVMNNIFTIAKRNVEGQDMLYQSLKLTNNIWVLLELKLTPGVTTATLSLKSRSVEVAPYVFQAFEAVLKNC

SEQ ID NO: 12097 - protein, 165 aa, Meligethes aeneus
MPPKFDPTEVKYVYLRCVGGEVGATSSLAPKIGPLGLSPKKIGDDIAKGTADWKGLKITVQLKIQNRQAAISVVPSAASLIIRALKEPPRDRKKQKNIKHSGNITLDDIISIARQMKPRSMAKQLSGTVKEVLGTAQSVGCTIDGKPPHDLIDEINNGSLEIPEE

SEQ ID NO: 12098 - protein, 359 aa, Meligethes aeneus
MRALILVGGYGTRLRPLTLSRPKPLVEFANKPILLHQIEALVEAGVTEVILAVSYRAEQMEEELTAEATKLGISIVFSHETEPLGTAGPIALAKNILQKSAKPFFVLNSDIICDFPFKELAAFHNSHGKEGTIVVTKVEEPSKYGVVVYDDGNCIESFVEKPQEFISNKINAGLYILNPSILNRIELRPTSIEKEVFPGMASDKELYAFELQGFWMDVGQPKDFLTGMCLYLKHLRSQNSEKLYKGPGVVGNVLVHPSAKIGSNCQIGPNVTIGPGVVIEDGVCVKRCTILRDATIKSNTWMESCIVGWKCSVGRWVRMEGTTVLGEDVIVKDETYINGGQVLPHKNIANSVPEPQIIM

SEQ ID NO: 12099 - protein, 297 aa, Meligethes aeneus
GELDEPNLKMADGDDIVTDQEKVRIVTDFILHSPPGEFNEVFNDVRKLLSNDDLLKDGAGGAFSQYNKDQLTPVRIENADHLVLITEYNDLGGCRFFDPRSKQSFRYDHLRKEASDYQAFSPDSAAEPWRAALDAEFIHYTRNHYKDGVSSVVSRNQGGVITLTACIEDHQFQPKNFWNGRWRSQWSILINSGAATAEVRGILKVQVHYYEEGNVQLVSTKEIKESISVTSEAQTAKEIVQLIETAENTYQTAISENYQTMSDTTFKALRRLLPVTRTKIDWNKIVSYSIGKELKTQ

SEQ ID NO: 12100 - protein, 580 aa, Meligethes aeneus
PTLSQWQYDVMPKYMCCLWQEEQAVGCETLRFERRPTQDCVAYQAPGIAGIYGDPHIITFDDYPYTFNGKGEFVILKTVSKTNNLEIQGRFEEMPMNAYGDVKATQLSSVVAKGNSSTIIEIRSRPREARWRYRLDVLANGKQIYFDRPSLKFQHFSGVTVYTPTYIYNQSEVVVMFDNGAGLEVIENDGFLSARVYLPWSFINKTRGLLGNWSFNQLDDLALPDGRIVSLPSKDEDQKRLYDDFGLKWMLDDSDVPDVGRAMFYREFGRTSSTYNNKTFVPEYKFKPEDIIPANRSKFIEDAYQICFTDNRECLYDYSVTLNRDVAHFTSNYKATILKMKEISRDKIISCGVLETPRFGRKNTYLFTPGTKVTYECNTDFILVGDPRRTCLPNGRWDIPNYGYTECLRQQEYSSRNAATTWGIILAILIPLILLLLYGAWRVYQNYIDTDDTTWKYDPASRRASSVQKLNTKAPVEESEEYETDYDDADDEEVKPRLRSNSQTSKSSNKRRSYEKSYKTNEPIKGLPETDFEEKPWDPEVDGSVLSSPMSSPIQRPPPLTLPQKKPTRYSSQSSTVTDV

SEQ ID NO: 12101 - protein, 904 aa, Meligethes aeneus
MTEHLGLKWDPKNLEIRTMSVERTLEPLVLQVTTLVNTKGPSKKKKGKSKRANALVSTVEKATENFIEKGELIAYENPDITREMLNAVEEVKKTGTQMSIAAREFSEDPCSSLKRGNMVRAARNLLSAVTRLLILADMVDVHLLLKSVHLAEDNLEKVKNASSNTELIDNIKNFGQNVNDLMNQAAKRQQELKDPQLRDDLAAARAVLKKHSTMLLTASKVYVRHPELAAAKANRDYVLKQVCEAVNTINDVCQGRPQQPTSGPYDGPGELAAALDDFDDHTVMEPLAYNEVHTRPSLEERLESIISGAALMADSSCTRDERREKIVAECNAVRQALQDLLSEYMSNMGNNEKSEGLGRAIENMGRKTRDLRRQLRKAVVDHISDSFLETNAPLLILIKAAQNGNEKEVEEYALVFQEHSNKLVEVANLVCSMSNNEDGVKMVRYAAAQIDNLCPEVINAARILAARPRSKVAQENMDAFKQSWENQVRILTEAVDDITTIDDFLAVSENHILEDVNKCVLALQEGDAETLDRTAGGIRGRSSRVCNVVTAEMDNYEPCIYTKRVLEAVKVLNDQVMPKFTQRVQVAVHALSSNPSKEVDENDFIDASRLVYDGVREIRRAVLMNRADEDLDPEEVELDDPTLETRSKSSAHTGEHGVDEYPDISGITTAREAMGKMPEEDKQKILQQVEFFRSEKRKFDMEVAKWDDTGNDIIVLAKHMCMIMMEMTDFTRGRGPLKTTMDVINAAKKISEAGTKLDKLTRQIADQCPESSTKKDLLAYLQRIALYCHQMNITSKVKADVQNISGELIVSGLDSATSLIQAAKNLMNAVVLTVKASYVASTKYPRQGPVTLPIVWKMKAPEKKPLVRPEKPEEVRAKVRKGSQKKVQNPIHALSEFQSPTESV

SEQ ID NO: 12102 - protein, 358 aa, Meligethes aeneus
MFSFGNSTSTPKTATGFTLPTSTTATTSAGGFQLNIGAGDNKTSQSKPGVTLFAAPAAKTTAPGVVLPSFGATTATSTTGTSEAPPAFDIGASTATLSTTFTPIVGSSAPSTVGLLFTGSAQSTTSPKFSSLATTTSAAPSLTLGGTTSTAGTAVSISAAAATSAPAGSLTFGQLEDSINKWTIDLEEQGKFFINQAKQLNAWDSLLISNGEKILNLNGSIERVKQQQTQLNQELDFVLAQQKELEELIAPLEKDLMDIPVTDIDRNQMYQMSEMIDSQLKQMSDDLKEIIEHINESHKDEETSNPITQISRILNAHMNSLQWIDTNTAQISTHLEQINKMQDLNRRNMSLNNSFKGF

SEQ ID NO: 12103 - protein, 193 aa, Meligethes aeneus
MFIWDWFTGVLGYLGLWKKSGKLLFLGLDNAGKTTLLHMLKDDRLAQHLPTLHPTSEELSIGNMRFTTFDLGGHSQARRVWKDYFPAVDAIVFLIDANDRSRFVESKQELDSLLTDETLSNCPVLILGNKIDLPGAASEDELRNFYALFGQTTGKGKVARSDLAGRPLELFMCSILKRQGYGEGFRWLAQYID

SEQ ID NO: 12104 - protein, 164 aa, Meligethes aeneus
MGCQNCQNQELSVFCILIKFTLNKNKIKHTNMDPLDILEKRITALELQVLPKNGEINSAQAITELLLQTHNMLTSALSCREAISSILQHLSTINNYLDPNNGETELETEAKRQYLLECYPEIKETVQAIATIGSLTSFTDSANIKKVTELSQKLEELSVSNLGI

SEQ ID NO: 12105 - protein, 580 aa, Meligethes aeneus
MSNSDVYNDLTLFFTTEKFYLQPKASDELIVIDRASDEVSVAKNCGQIPPNSCSQDFCGLLGVIKLVAGRYLIIATQRELVGNIAGHAVWRLVQIKLIPYSRSMLHLNTEQAADNQAYISMVEQILATPNHYFSYTYDLTHTLQRLHDFGPDFWQQSLLERADQRFVWNGYLLREFKGLAGAKKFCLPIVHGFISINQCVLNGANLSWILISRRSVQRAGTRLHRRGIDKDGNVANFVETEQLVDYQGDKASFVQVRGSIPLFWHQNPDLRYKPPPTLLEIDPQEHNAACQKHLEALAVLYGKQVMVDLVDQKGSEGRLEKAFKDTIHTLAYPSVKYEPFDFHAECRKMRWDRLSILIDRLALDQDEMGYFLLLRDGSLSLLQEGIFRTNCIDCLDRTNVVQSMLAHRNLEIVLKKLNVIQTNQRLEEQYTFEHLFKNVWADNADVISTQYSGTGALKTDFTRTGKRTKFGLIQDGINSMTRYYKNNLSDGVRQDAIDLFHGNAEVISPLRIDRGWRYMTFPSVLLVAVAMFVASAVLPAEYSTESLLYLLFWGSMVGASGLNILKYGIEFVDKPRLTQS

SEQ ID NO: 12106 - protein, 543 aa, Meligethes aeneus
MPPTIQNGSNAAEKRPVKPAEKRSDLICKVKYCNTLPDIPFDLKFISYPFEPTRFIQYNPTSLERNYRYEVLTEHDLGVGIDLINKEIYSVEFGAQLDPADEKLLEEDILTPQDSKRSRHHAKCVSWLRRTEYISTEQTRFQPQTMDKVEAKVGYSIKKNLKNETLYMDHDSQIRAIEKTFDDTKIPIEKHYSKPNVVPVEVLPLYPDFSLWKYPCAQVIFDSDPAPVGKQVPAQIEEMSQAMIRGVMDESGEQFVAYFLPTEDTLEKRRQDFINNVAYQDDEEYEYKMAREYNWNVKSKASKGYEENYFFVVRQDGIYYNELETRVRLSKRRQKVGQPASNTRLIVKHRTMDGNEFRMQRYRERQLEPPGEDEEEFEPEPEEIQQQDEESQAGSDQEKEDDKEEKGSSDGERSRASSRASSKRSSSRSRSRSKSKSRSKSRSRSRSRSRSKSKSKSRSRSRSKSSSRSRSRSKSRSRSRSASKSPSRSRSRSKSKSKSRSRSRSKSQSRSRSRSKSKSRSRSRSGSASGSDSGSGSGKSDSE

SEQ ID NO: 12107 - protein, 389 aa, Meligethes aeneus
MPIENLEDQGLEKNPDLELTNFKFLLTLPEFRSDRSVHQKISDAIKKDDMAPWYELVCKDAGWKLDANLLKQLKTKNEEQIKKLDEAIEDAEKNLGEGEVREAYLRKAEYYSRIGDKDNCVSTFRQTYDKTVSLGHRLDIIFHLIRIGLFFMDHDIIVRNIDKAKTLIEEGGDWDRRNRLKVYQGAYCMAVRDFKTAATLFLDTVSTFTSYELMDYKQFVRYTVYTSIISLPRNQLRDKVVKGSEILEVLHSEPFVKDYLFSLYNCQYAEFFTNLAEVESVLRKDYFLNPHYRYYVREMRILAYTQLLESYRSLTLQYMAEAFGVSKQFIDQELSTFIASGRLHCKIDRVGGIVETNRPDLKNAQFNSVVKQGDLLLTRVQKLSRVINI

SEQ ID NO: 12108 - protein, 209 aa, Meligethes aeneus
KDTKDELSDILGPHFNLEAIPNMNSKDVEDIFKGVLTDESQESQESNLFPIQSNPVFPPTPAPQNPMPNPISMLNPVVRPTTLPNVNQSALNSPHSFPPQSPYHSEYSNSPQFSPAFSEPPPSPWVGSDNSEMDSSSGQSTYNQRSSEKMKADESLCDKATISAVLYANVKHPEWKSEYPIWTDRYKQILKKWRTLSQDQKAPFLQQAR

SEQ ID NO: 12109 - protein, 285 aa, Meligethes aeneus
WLDVKNPQPVANPVSWCQFEINCSNPGDMGAAQSPKPIPPPPLAVAAVNMRCAINPKTLQNEIVMISCLTHTRYALDKQPPKPPFEHHFCVLTCPKSSMMPLDFHKQLGNYKATKVQKMDSEKALLNYFINQFSRIDPDLVVGHDLQGYQINVLFDRLKANGNAAADKIGRMRRADKLKNERVLFVGRLVCDLKRSAKELIKSRSYDLDALCSAVLRVKEGLRVELEPEDVPKMYQTSENILKLVSFTMQDTSYILQIMYDLNVIPLALQITNIAGNVMSRTLMG

SEQ ID NO: 12110 - protein, 256 aa, Meligethes aeneus
SFARARDYDATGQQTRFVQCPEGELQKRKEVVHTVTLHEIDVINSRTHGFLALFSGDTGEIKSEVREQINGKVAEWREEGKAEIIPGVLFIDEVHMLDIECFSFLNRALENDMSPIVIMATNRGITKIRGTNYTSPHGIPLDLLDRMIIVPTSPYNEKEIREILSIRCEEEDCQMSENALGVLTRIAKETSLRYGMQLIMTSSLISRKRKAQEIDVEDIKRAYQLFSDDSRSVQFLREYQQEFMFNELGEDTMDTN

SEQ ID NO: 12111 - protein, 371 aa, Meligethes aeneus
MALRTYGDKPISFQLEDNGEYYCVGSEVGNYLRLFRGSLYKKYPGMYRRSITNEERKRLIDLGLSQHVLASSVSLLRATEVEDIIEGNDDKYKAVSVHTSDPPLVREGKTKKNMQWVPSLPNSSHLDAVPQATPINRNRVAAKKVRTFPLCFDDTDPEINAENACQGELLVPIRLDMEIEGQKLRDTFTWNKNESLISPEQFAEVLCDDLDLNPLTFVPAIAQAIRQQLEAFPPEPPAIMEESCDQRVIIKLNIHVGNTSLVDQIEWDMSEKKNNPEEFALKLCAELGLGGEFVTAIAYSVRGQISWHARTYAFSEAPLPTVEVPFRSTSESDAWAPFLETLTDAEMEKKIRDQDRNTRRIRRLANTTTAW

SEQ ID NO: 12112 - protein, 207 aa, Meligethes aeneus
MFCCCSYREDRGKGPMAAIRKKLVIVGDGACGKTCLLIVFSKDQFPEVYVPTVFENYVADIEVDGKQVELALWDTAGQEDYDRLRPLSYPDTDVILMCFSVDSPDSLENIPEKWTPEVKHFCPNVPIILVGNKKDLRSDPSTINELKKMKQEPVKPQDGRSMAEKINAFAYLECSAKSKEGVREVFENATRAALQVKKKKKHRCVLF

SEQ ID NO: 12113 - protein, 1320 aa, Meligethes aeneus
MNVSSIIDQTMDNTRMPLQKMEIAARNVDRSLNIDCSAPRLIDQLNVNAQTGSTASGLIDNDYPLLNGIPFTLNNMTQIKTVNNIPLPPEIVDHFTHIQCHCMMGLFPEINRAWLTVDSDIYVWTYEENSDLAYFDGINETILCVGLVKPKPGVFHNFIKYLLVLTTSVDIVVLGVTFTEGAEGDNDEIQLIPDPVFTISTDGATISTISGTDSGRLFLGSKEGNLFEISYQAESGWFGKRCKKVNLSTSSLSFLVPSFLNAALSEEDGIAQIAIDNTRNILYILTEKGSIEVCDLGEKGNTFSRVTKLSQAQLVSQAMTTVKTLDSQNFRPIVSISAVEACDSANVNLVAVSQTGVRFYMSVVSLSNQLPNQRPYTLALLHVRLPPGYSANIAVRPRCVHMSHYRDRNCVLVSTVKDKDVLWCISSDLFPFNSTLMEAYTTVNLDGPVLAIAEVRHDSPLQDPNFEAPPLAVRQHFEAQKKYVVLTSHGVQILVKLRPVDLLRQILRDSRGHDSETLKAFFMILKEDQACAASLILASLENDENTEIADCATRCFFTFGGEPKVALLNQTSALSGSTMFSPNIISTPAHNYQQNMYNMQSPNLSQTQQSPNFEVVCPFVFSSKHNGLYLYLGRILRPVWNRRCVNKVCIDGKTFTNVSTISINDCIWILNNLTALHNFITQNTQLSSVCNTSSNANANGSFANQTTNATRSTVTVREAQLEERRSLDALKIFANQCCQLLGFWRILCEHRFHELIGSLPENQQQVLQNTTFKELFLYRHDICSFLIATLVNSYLGDNASVDSISNKLREVCPQLYKSEDAAFSKANEILKMIRTVQNTDEKEEMLISALQLCKSIGANIKLREISRQFTALKAYKAVIELCHYYAQKVDPENIAEHFYNNDDNAADHEGYGYYRKRMEVYTEVLAMLDTIYFEQNENRQATFADDCAVDSVTRQVISQVLDYPDEIMHIALYEWMVSKNMTSDLIKISQPSLEVFLKRSSNKDNGNIAVMDLLWKYYESNNNHASAAKILNGLASQSGGAVSLKERLSYLARAIMCMRSDKVGYAPCLGVFLRDLEDKMEVAKVQEQILDAITNMQNSVPNAQEVITILNSGLFEISQLYENFAEPFKLLECQLAIIDCAGYTDNVLIEHIWRQILTNELRKSSGSGNDRMAQVLTKVKHLARYYASSLNCFPLDNIVYELEMLNSRLRGDKNLVPQTLVTLNVPFEKLVAVYNNLITLSANDQEWQKEENEFHLSEATSFLIYYFLDNNDSFNSIEKRKITSLCQDAVATLFSILYSKPNTEHLVNQLRSIKAQLSRI

SEQ ID NO: 12114 - protein, 1390 aa, Meligethes aeneus
MSEFTLSYREVIPDQTVLDSWKDITLSTGGTQSTLQDIKVAEKANGYCYEDSTKTHTRNRFIHWRINNDVLELVEHSLDINLTGNRIRYKIVDTPILDGVSIHESIDNVIVLVPTVCSIHRLVFPHPDRFHRQDDLGSYPDLAAPSIFSKATAMEAKNPNTFHVFNNPHSANDQLPNLACSYLSADTEEAVFVLAYPSTEMLLIKQNREGQCISMEMKGESLMPRFLSGLAEKFRQKNSEADNIVSLLIILLDNEMYAVTLCRDGHLKFWSCSRGHCVAVIDVLTETGDTNRDLVQGASLRKALNGYHTSENTLVVFMSFSTGCQFHILKPVLSGQQIRIVRLNTLHSPENDLIDFALQPNRLWSAWRCEDGDCAAFSASLYANGDESSSWTPVILETLPDANQYPAVDDEIDPKQAYLQHIFHPGRFPLHIISKALCIYSRSNALADTNLSATALKQRICMAVESEIRTVLNEQTVNDQEYLECAQWCWQKFYSCCVQYHVAGLKPLGLLLLPAVSGAVFLKKSTFSFLRPLEPLEHMTLCGDYMYKDQFVEYPLLGDDLDNMGDVMSLFQVIVYLEQQMSDIFLTTFEKEMATLQSPDVIMSKLLEKIHTEMDSEFTNQVSGMLGQCCDLYKAVHKVLELLRYENLNTCDSDVNPFALHHFSSHLGVSVVAGCIRQQAVTRFSICRNLLLICNILLYRKELEWGILEAIRSVCMPEIVVFTQASYVMMWLSSLQGLVNLPHDSSLQRLAPIKLNPVYNLRNNSFQSVSLLDMFISSSGGQEARKTFCRIKYCDEDLAHWHLSLLPYLNHLRHIIWPVGGSTVLAEWLLSSGQHLWLQQYVRLLSNWCEWNSCTRSFLLAASYLTSGENYKAQELFETAAKGIFLDKFLSERILKNRSADDSQTKAYVTYYIKVIQLFELHKAKDCAIRVANTALSIVDKDDPLMATLYSIKFKHHLSLKHYEKAFDSLNSNPDVERRKDNLRDLVKCLLDEKKLDTLLNFTYGSMDEFFTNILLTRARATDAVNNIYYDFLYSYQIKRGPLCHRLAASVMYEQAFRLTQFNTTEALEKQVKCYLAAKNILQLCDPKHAWIARPTDADESDDEIVIEPMAGTGTVENLQKIKLQRQVEVVNINIIKKDLIFACAKLKLLRFSSGSSLNITTPHELVSLLNNAGLFKTALKICINFKVPYESVFDTLTKHCVLLTEQDHPNAWDWLVENDLQDLPVNRDCIADVVWQLLQECLRTYEEPNMTTLHSVVLRKIIGMKMFVPFWLMESYKKRNPGELLKILHSSGRLEEAATMARDYLSAAMGYGKELYGFSAPLAHTSKPFCMPVYAIQNLIKELEIQNKVNLEQPFKMEYTSLQNLFMEYLQTSSRISFEMCNFKRLSVK

SEQ ID NO: 12115 - protein, 969 aa, Meligethes aeneus
MEISDDNLQTLARYLQETLNPDVNVRRPAEKFLEGVEVNQNYPLLMLHLVHKPEIDMTIRIAGSVAFKNYIKRNWNVEEDQADRIHQADRAAIKNLIVTLMLTSPESIQKQLSDAISIIGKTDFPLKWPELITQMVEKFATGDFNIINGVLQTGHSLFKKYRYEFKSNELWTEIKYVLEKLAKPLTDLLVATVNLAQTHASDPNALKIIYHSLMLICKVFYSLNFQDLPEFFEDNMQTWMSNFHNLLCVDVNSLRTESEEEAGVIEQLKSQVCDNIALYAQKYDEEFQPYLPQFVTDVWGLLVGTGLQPKYDLLVSNALQFLSTVAERNHYRNLFEDNTVLSSICEKVIIPNMEFRVSDEELFEDNPEEYTRRDIEGSDVDTRRRAACDLVNTLSVHFEQRIMEIFGQYLQGMMGKYSENPKQNWRSKDAALYLVTSLVSRGSTQKHGVTQTSHLVSIPQFCQQQILPELERQDVNELPVLKADAIKYVMTFRSVLPNEMVVSTLPQLIRHMTSESAVVHTYASCALEKILILKDAGNKPLVTGAQLEPLSNELLSNLFGVLTRPVSEENEYVMKAMMRTFSTLQERVVPFLSVALPKLTEKLQMVAKNPSRPHFNHYLFETFSLAIRIVCKQNQSAVKSFEDILFPIFQGILQADIQEFIPYVFQLLSLLMENTPPGAVPETYMQLLPCLLAPVLWERPANISPLVRLLSAFATQAAPQIVGQDKLGGFLGVFQKLIASKSNDHEGFHLMRCIIQNVPTEALQAYMKQVFFLLFQRLSSSKTTKFVINLIVFFCLYAVKYSANDLVVTIDGIQAQMFGMVLEKILIPDLQKVAGNVDRKIVACGITKLLCECPEMYTGTYQKFWPQLLQALIAFFEMPVDETSLPDDHFIEIDDTPTFQTASAKLNFANTQKTDPLQAVGEPRQFLAQSLASLGSSQPGRLPSYISNTNQQSQTTLQGYLSKFGVQLS

SEQ ID NO: 12116 - protein, 200 aa, Meligethes aeneus
MAKVQLCNITVMDNPSQFLNPFQFEITFECIEELKEDLEWKMIYVGSAESEEYDQVLDSVFVGPIPEGKHMFVFQADPPNVSRIPENDAIGVTVVLLTCSYRSQEFIRVGYFINNEYSDPELKENSPSPPQFDKVMRNILASEPRVTRFKINWEEPNQQENGQGSGENQAQTSSVEDNSASGQIPSFNENSNSWATMECS

SEQ ID NO: 12117 - protein, 306 aa, Meligethes aeneus
MDQMLPSPGFSIPSIGTPLHQPEEDQLILPNALQQQQQQNLSQVPPLAPMGGLTPTLGLGMGMSMPTRYVPGYGSSLQSQTPQHTMMSPMINLGGTSGGPGATPSSNMGPATPATPATPQTPHSQDPGIVPQLQNIVSTVNLNCKLDLKKIALHARNAEYNPKRFAAVIMRIREPRTTALIFSSGKMVCTGAKSEEDSRLAARKYARIIQKLGFNAKFLDFKIQNMVGSCDVKFPIRLEGLVLTHGSFSSYEPELFPGLIYRMVKPRIVLLIFVSGKVVLTGAKVRQEIYEAFDNIYPILKSFKKQ

SEQ ID NO: 12118 - protein, 157 aa, Meligethes aeneus
MALRSVTRLFSRRALSTTTVRGYSDEMSFTLASGNQVFYDAKSVKQVDVPSFSGSFGILPKHVPTLAVLKPGVVSVIEDSGNVKKIFVSSGTVTINEDSSVQILAEEAHPVESLDRSAAQEVLSKAQSSMSSASTEQARAEAAIAIEVGEALVKAVE

SEQ ID NO: 12119 - protein, 323 aa, Meligethes aeneus
MSGDGNQMETFDSLFLSIAQHHPQGASQLLDTFVNFLGRKTDFFIGGQEGAWQSLVMSTFKKYEKISRDAHEAELKLKKEKEAVKKAASAKKQEAEVVKPAEIKELTDAEAEQLQAELNAKKGGSEAAPAKAEEGKGNDEEEEDEAEKGKLKPNGGNGCDLEKYKWTQTLQDVEVRIPLNVNFRAKQKDLVVNLTKKHLTVGVKGQPPIVDDDFPYEIKLEESTWVIEDGKSLLINLEKINKMNWWNKLVKSDPEISTKKINPEPSKLSDLDGETRGLVEKMMYDQRQKERGLPTSDDQKKQDVINKFMQQHPEMDFSKCKFN

SEQ ID NO: 12120 - protein, 151 aa, Meligethes aeneus
MQGHSAMPPPLQWSPDKKHSDRERWVCIYPAYINSKKTLAQGRRISKEKCVENPTHQEIRDVLLAANLKVGVENKIYSRERSKELLYRGRIRVQLKNDDGSLFNPSFPSRESIMLHLGDMIPKLKTRQTKSGGEQQQSTGNKGKGKGKGRR

SEQ ID NO: 12121 - protein, 451 aa, Meligethes aeneus
QIFERAVQFYGDDHLDEKLFIAFAKFEENQKEHDRARVIYKFALDHIPKEQSKELYKQYTIHEKKYGDRSGIEEVIVSKRKFQYEQEILQNPTNYDAWFDYIRLIEGEGEVEITRETYERAIANIPPSKNKQFWRRYIYLWINYAIFEELEAQDYERTRQVYKACLDLLPHKVFTFSKVWLLYAKFEIRQKNLTTARKVLGMSIGMCPRDKLFRGYIELEIQLREFDRCRRLYEKFLEFGPENCVTWMKFAELETLLGDVDRARAIYELAINQPRLDMPELLWKAYIDFEISQEEPDHARRLYERLLERTNHVKVWLSYAKFEFNNHSEDEINIGLARRVFERANETLKSCVDKESRVLLLENWKEFENTHGDNVNKEKVNSKMPRRIKKRQKVIDEDGFEQGWEEVFDYIFPEDEASRPNLKLLAAAKNWKKKAADDEPSESDKSAERES

SEQ ID NO: 12122 - protein, 254 aa, Meligethes aeneus
MGIKFLEVIKPFCSILPEIAKPERKIQFREKVLWTAITLFIFLVCCQIPLFGIMSSDSADPFYWIRVILASNRGTLMELGISPIVTSGLIMQLLAGAKIIEVGDTPKDRALFNGAQKLFGMVITVGQAIVYVMTGMYGDPAEIGAGVCLLIIIQLFVAGLIVLLLDELLQKGYGLGSGISLFIATNICETIIWKAFSPATVNTGRGTEFEGAVIALFHLLTTRQDKIRALREAFYRQNLPNLMNLLATVFVFAI

SEQ ID NO: 12123 - protein, 161 aa, Meligethes aeneus
MSSITSPSVELSSYRDQHFKGSRAEQDRLLRGTTTLYIGNLSFFTTEEQIYELFSKCGDIRRVIMGLDKYKKTPCGFCFVEYYNRADAENCLRYINGTRLDDRIVRTDWDAGFIEGRQYGRGKTGGQVRDEYRTDFDGGRGGYGKIIQQKIGSGPETTFPR

SEQ ID NO: 12124 - protein, 306 aa, Meligethes aeneus
MAATVGRICGAGLLKSANGASVTQISSFSTSREWTRGRKALMGTLGMLAGGTGALLFALDRSVKASDLELHPPKNPWSHDGILSSLDHAGIRRGYEVYKQVCAACHSMRFIAYRNLIGVSHTEAEAKAEAEEIMVTDGPDELGNMFKRPGKLSDYFPSPYPNEEAARAANNGAYPPDLSYIVDARHGGEDYIFALLTGYCDPPAGAVIREGQYFNPYFPGGAISMAQALYNEAMEYTDGTPATASQLAKDVSTFLKWTSEPDFDDRKRMFIKAVGIFSILIALTYYLKRHKWSSIKTRKIEFKPRN

SEQ ID NO: 12125 - protein, 595 aa, Meligethes aeneus
SRLTIVNNPSFPLKQLKMLSIQQYSDSSDDDSPKEPLEDKTTAVINQDYLKPLPPEKAKFSVQKQLQICAAPIVLPTGVDEDKIHLHPDTKEVEFNPKYEELFAPELGPHNPYKTQQRAFSKNMLSGHVEAAHVSDFQFENQRRTFASFGYALDPSVSGEGEKLKVVGAKEVNSESTEITTVFETTKVRPLDKRKRKKNTDAGDIEGFLGPWGGFIDEQRIMKPTEEEAIELEELVSKKTKRGKVVEEKPIEEKSVLHIKDALDYQGRSFLHAPQDVGVNLRSDSPPEKCFLPKSHIHTWSGHSKGIAALRWFPRTAHLFLSASMDCRIKLWEVYNERRCIRTYYGHRQAVRDINFNNSGKHFLSAGYDRYIKLWDTETGQVLSRFTARKIPYCVKFNPDKNKQHLFVAGTSDKKIICWDTRSGDIVQEYDRHLGAVNSITFVDENRRFVTTSDDKSLRVWEWDIPVDMKYIADPTMHSMPSVTPAPNGKWLACQSMDNKIVIFSALNRFKINRKKVFTGHMVAGYACSLDFSPDMSYLVSGDADGKCYIWDWKTTKLYKKWKAHDNVCISTLWHPHEASKLLTAGWDGLIKYWD

SEQ ID NO: 12126 - protein, 113 aa, Meligethes aeneus
VFPDLVSAVVEVGLDRLDQLVEVRSVPRVHLRQRDGRASLTSHQQSQAGFAFHDAVRYPHLPAEGRQEQNQLNWVDIVGDDHQLGFFLLNQLCDRVGTGAEHVWLLGWRLFFL

SEQ ID NO: 12127 - protein, 329 aa, Meligethes aeneus
MATLIKDVKLENVPTEVLFDKHKEFLQSYEKDENNYEYGMTDYLRISGMYWGLTALELMSINTKNQKVIDFIVKCQDPESGGISGCIDHDPHMLHTLSAVQILVTMDEVNAIDVEGVVKYVVSNQQEDGSFTGDKWGEVDTRFSFTAVATLALLNRLDAIDVKKAVEFVQSCMNFDGGFGSRPLSESHAGLIYCCLGFLSITNSLHIVEQDTLAWWLCERQLSSGGLNGRPEKLPDVCYSWWVLSSLSILGRIHWINHSAIQNYIKACQDVETGGFSDRPGNVTDPYHTLFGLAGLGLLGDERIIKVNPTFCMPQAVIDKLGLKPQILS

SEQ ID NO: 12128 - protein, 883 aa, Meligethes aeneus
MHQETLQLIQILEKTVSPDKTELEQASHFLEQAATTNLLEFIRTLSDILRHGGNSHVARMAAGLQLKNQLTSKDATNKVVYQQRWLAFPEEVRSYIKKNVVGALGTETNRPSSAAQCVAYIAVAELPQKQWPDLIQTLVNNVCHANSTEMQKEATLEAIGYICQEIDSDVLVTQANDILTAIIHGMRVSEQSNHVRLAATQALLNSLEFTKGNFDQPTERNFIMEVVCEATQSPDSQIKVAALQCLVKIMSLYYQYMEPYMAQALFPITLEAMKSENDAVSLQGIEFWSNVSDEEVDLAIEDTEATEAGRPPSRVSRHYAKGALQFIVPILLQKLTKQEELDDEDDWNPSKAAGVCLMLLATCCEDEIVPHVLPFIKEHIKSENWRFRDASLMAFGSILGGLETTTLKPLVEQAMPTLIELMYDSSVIVRDTAAWTFGRICEIIPEAAIHETFLKPLLESLVTGLKAEPRVAANVCWAFSGLAEAAYEAAEPNEETGNPDTYVLSQYFDFIVERLLETTDRPDGAHANLRPAAYEALMEMVKNSPKDCYVTVQKTTMVILERLQQVLLMDTHITSHYDRSQFNDLQSLLCGTLQSVLRKVTPEDAPRISDAIMTAMLTMFSSNSCVQEDALMAVSTLVEVLGENFLKYMDAFKPFLYIGLRNHQEYQVCGTAVGLTGDIFRALKHKALPYCDEIMALLLENLGDQTVHRTVKPQILSVFGDIGLSIGAEFKKYLEIVLSTLSQASQAQVDRNDYDMIDYLNELREGVLDAYTGILQGLKGDGASPNPEVNILEPHIPFIVQFITVVAQDQEHSDGTVAVAAGIVGDLCAAFGAPMVQLLDLEPINEMLAQGRRSRVNRTKTLATWATKELRKLKSQSTAVAAS

SEQ ID NO: 12129 - protein, 500 aa, Meligethes aeneus
METILEQQRRYHEEKERLIDAMVKEMLHKKNSYRETINSDQRQKYLLDRYMNGTEKLIELYEDKDGQRKAEVAALTGPNEFNEFYNRLKQIKDFYRKHPNEISVPMSVEFDEFAKARENPSEEMSNLVEFTDEEGYGKFLDLHECYEKFINLKGIDKVDYISYLSTFDQLYEIPKERKSGEYRKYLLTLIEYLSWFVQRIRPLMDLDKDLQEEADSIINIWESGTVPGWPKETGSALANVGAHLDLSAFSSWEELASLGLDRLKSALLALGLKCGGTLEERAQRLFSTKGKGSLDPSLMTKNNKGKANKEKEQLRHRDLAMLEAQIYRLADLVSTQRGATKENVQRKQARTDGERNDSENEESEEDSPDEGDDDVPYNPKNLPLGWDGKPIPYWLYKLHGLNISYNCEICGNFVYKGPKAFQRHFAEWRHAHGMRCLGIPNTAHFANVTQIEDAIALWEKLKVQKQNERWQPETEEEYEDSQGNVVNRKTYEDLKRQGLL

SEQ ID NO: 12130 - protein, 214 aa, Meligethes aeneus
KMTIGKNNKMIQHINYRVRVTLQDSRTFIGTFKAFDKHMNMILGDCEEFRKIKAKNSKVEREEKRVLGFVLLRGESIVSLTVEGPPPPEEGLPRVPIPGAAPGPGIGKAAGRGMPAGMAGVPVGLQGPVRGVGGPSQQVMTPGGRGQVAAPPQMNQGPPRMGGPPPGMMGPPPGMMGMPPNMGMGRGGPPPPMGMRGPPPGMMRGGPPGPPRPY

SEQ ID NO: 12131 - protein, 367 aa, Meligethes aeneus
MRLKDEKKFRNYHRMAIEDFDNLVEKVSPFLRKTFISREPISPGEMLSVTLRYLASGESMRSISYSYRLGLSTVSNIIKSTCSAIWKALSEEYLPYPTEQSWKKIAVDFESKWNFPNCVGAIDGKHVRIQAPQHSGSDFFNYKEFFSMILLAVCDANYRFTVVDIGAKGRQSDGGVFRNSTFGKQFFSNSINLPAPRKLADDEEPTPYCFVGDAAFPFGVNLMRPYPGNFLPQNERIFNYRLSRARRTIENTFGILVARWRILEKPIIAKLETIEKMISALVCLHNFLRKSDSDKVDSNRYCPSNFVDRETETGELIEGEWRNLVHNGLPNAGRMGGNAYSQGASAMRNSLADYFIHVDPIASQLLK

SEQ ID NO: 12132 - protein, 1262 aa, Meligethes aeneus
QQLNMNQQQLLQNKLQQQALLQQQQQQQGNLDGNGSNDPNLMQRAQLLHRQNLVRQQQQTQQQAIGQPQPLTPQQHQNMLHQQKLLQQQQLAQIQARLQQQQQAQQQQLNNPPQSPLSMPPKSPMINQQIMSPHSMPASPMPPQSPMSVRSPAFSQSVGQPPSSPMRSSPMPRSPMVNQIQSPMSMRSPAMPERPTSVENPGTPRTPYNPQNVENMQENNVSNTTTDGGGGNPRNPVNPIPFPFGRFGSFKLGLRGGSPMWGGFGRGAKRVPTPPVTSTGVGACVSKPIAATNALVDSATSQVPPKPKKESHYSKVSILKKKSAPTITNRQSFVANKVSSLVSSDYNEFDDSSSTPPVTPPPSSSTSRNVVQKTIHKKIAEETKEKAKERLMILQSPEPKQIHEIIDYDDDNNTVLSGEVSLSSVAQQNDGDDIEIETLSQNDLTEDLSSPLEADQITDEYLLFPGNMVVEEEVDDYASENMHFVIRSPTTSDDEYIMQGKTKKYNIVSSEQLMAINDTPESPEQEEMNVDPSPEPTEDEENEVEESISTKEDFEELIDEGSRKEKLKNDGNVTAKHINEFHKYAATTVYSFPPKASGSQQTTARIANINKMPQKISLITPLVSKNDAAKELIIAPNAKIVNHTQPTSKVTSIILTPHPVRSNVLTPKIVSAGGQPITIVSANSKSKFTVPIISASAVRQLSNIKVIDKSISLTTHDSSLPKKIFEDDSVSPDSSNCEEDAKSKDYSDEKLKDSPITDETKSQVFAKNESFKIIKTVKSDNMVVLNKQPENVKIEKKEQNKPKVLEKKELHPIHTIENVKITNIITKQRIPSPIIAKSSSPVIIRSTPELKMTAQVFQETSQNRIQISTDTDCNSTDDTKSVVISIPSPTPSQEQMLDDIAMRAYETRRHGTAIPGTFDSFEDVLDMFENITAEPGTILDEKEKVKQSNETFDSAKKAEPEKKHTANNATISKPAMTQMPVTVTTTSTKSSVVPQLSPLSQPTELTTNMATASQQLRNLLSLQTTTGSSPTNVETLVKTQQKNVVTTASTLGVLPQQPAVTVTSVGTVVSSIKQLPVSTKTNTVKTQFTTNVVSSSTTPTFTTHRNVGGIQLMPDHSKLPPVTQQQPSTSVVTTPHSNTVVVHRAPLVNTTPTTTPNGEQRKPSLTLTAMLQNQPAATPTTKTTPDSITAASLLATPVSISRGFNTALVQAQPNVSVSSIVATTNNVTSESVTAFRSVTTTTNLLHTQLTKVRNKSVEEPKE

SEQ ID NO: 12133 - protein, 698 aa, Ceutorhynchus assimilis
MPRDSIRHRYRYDDHSSSSRHRRKSRSSSEEFRKSTKKSGKSGSERRRSTSSKRSKSNHNRRKSPHKSKKHDSDSDSSSSSDSSDSNKSIKLLKKLEKKRLQEIEERRKQKELMKATETAEEKRLRRLKKKEEKERKRKERMGWDNEYLHYTNSDNPFGDGNLLSTFVWNKKLAKEGLTNASRAELEARNRFKQDESKRELEKVKKRRLERELEKQRRDDDNQLLQRSKEAAQFEEWERQEDNFHLEQARLRSHIRIQDGRAKPIDLLAKYISAEEEVDAVEMHEPYTYLNGLQIKDLEDLVEDIKVYKELERGKNLDYWNDITVIVEDELQKLRKLQREQDFDAGIGRREGINQAVAQDVTAVFKGKTAIQLEDLQKQIESKISGKSDGIDIGYWESLLSQLKAHMARARLRDRHQLSLKRKLQVLKAEQAVTVPEINAENSNQSSQSPQESKPGTSQESADNESQSDEEGENNEEAASDILNECFVAYQNGNYSPKLLNSEQIEPGTIVVSEEDDIKRLEFARLQVTNKGKKVENVITKEELLLQKEARSGMGEDEAQFSVEQALDSQVYLWSDKYRPRKPRYFNRVHTGFEWNKYNQTHYDMDNPPPKIVQGYKFNIFYPDLIDKNCTPEYFLTPCPENREFAILRFHAGPPYEDIAFKIVNREWEYSYKRGFRCQFHNNIFQLWLHFKRYSSRR

SEQ ID NO: 12134 - protein, 416 aa, Ceutorhynchus assimilis
MDNLEANIMDKSMRSVFVGNIPYEATEEKLKDIFGEVGQVLSFKLVYDRETGKPKGYGFCEYRDQETALSAMRNLNSYEIGGRNLRVDNACTEKSRMEMQNLLNQPPIENPYGEPVQSEKAPEAISKAVASLPPEQMFELMKQMKETIQNNPTEARQMLLQNPQFAYALLQAQVVMKIIDGYTAASLLHPVNQVPATLMPGDKNVPVQVPINREFQAAPAPVAPPRQEFQPVPAPIIIPNTNHSAPVFTSMNDVDFRAMDPRVPTVDPRLNRMADQDLRMPPAVQISNPLPPVESFSSAASTEPNASFPRDPREVRNGPGAFSNDPRQLGRVDPRQKAAAAPVPVSQPPRPSQAAAAASMASVNGAMPPGASDQEKAALIMQVLQLSDEQIAMLPPEQRNSILVLKEQIAKSAQGR

SEQ ID NO: 12135 - protein, 392 aa, Ceutorhynchus assimilis
MTAMEPEREKVLQDYRKKLMEHKEVESRLKEMREQLKDLTKQYDKSENDLKALQSMGQIVGEVLKQLTEEKFIVKATNGPRYVVGCRRQLDKLKLKAGTRVALDMTTLTIMRYLPREVDPLVYNMSHEDPGDVTYSAIGGLSEQIRELREVIELPLMNPELFMRVGITPPKGCLLYGPPGTGKTLLARAVASQLDANFLKVVSSAIVDKYIGESARLIREMFNYAKDHQPCIIFMDEIDAIGGRRFSEGTSADREIQRTLMELLNQMDGFDSLGQVKMIMATNRPDTLDPALLRPGRLDRKIEIPLPNEQARLEILKIHAGPIAKHGEIDYEAIVKLSDNFNGADLRNVCTEAGLFAIRSEREYVIQEDFMKAVRKVADNKKLESKLDYKPI

SEQ ID NO: 12136 - protein, 259 aa, Ceutorhynchus assimilis
MARRYDTRTTIFSPEGRLYQVEYAMEAISLAGTCLGILANDGILLAAERRNTNKLLDEVFTSEKIYKLNEDMVCSVAGITSDANVLTNELRLIGQRYLFQYGQSIPCEQLVSWLCDVKQAYTQYGGKRPFGVSILYMGWDKHYGYQLYQSDPSGNYSGWKATCIGNNSSAAISSLKQEYKEGGMTLKDAKTLAIKVLSKTLDMTKLTSEKVEMATLTRSNDKTVTSILTGKEVEALIKEYETTEASNEAMKREQSKAAA

SEQ ID NO: 12137 - protein, 889 aa, Ceutorhynchus assimilis
MSQTTAEIPTKVKTKKDAEEDKNELSEEDKQLQDELNLCVERLTENDENLYLSALNVLSMKIKASTTSMTSVPKPLKFMKPHYDTMKQVYDKIKNPEVQRVCADIISVLAMTLGDGRECLKYRLLSDLDKIGEWGHEYVRHLSGEIAAEWGEKDEDDKDMEAKVIQLAKQIVPYNMAHNAEAEACDLLMEIERLDLLERYVDENIYTRVCLYLTSCVEYVADPENTTLLQTALMLFKKFGQYPQALRLGMKLNEQKLIEEIFLSCPDTIVQKQLAFMLGRQQIYIEVPETTPEYEDLTEIMANCHLNNHFLNLARELDIMEPKTPEDVYKSHLENTRPSFGGSQVDSAKQNLAASFVNGFVNAAFGQDKLLMEDGNKWLYKNKDHGMLSATASLGLVLLWDVDGGLTPIDKYLYSSEDHIKSGALLACGIVNCGVRNECDPALALLSDYVMHSAPIIRIGAILGLGLAYVGSNREAVLGLLYPVFSDKSSNMEVIGMAALACGMISVGSENSQVTTILMQTLMDRSEDDLKDTYARFIPLGVGLCHLGKQDSVDAIVAALAVLPEPFGSMATTMVDICAYAGTGNVLKVQQLLHICSEHYDTDTSEKDKKDKDKDKKEKSEDKEKDHSARQAIAVLGIALISMGEDIGSEMAFRTFGNLLRYCEPVIRRAVPLALGLISVSNPKLSILDTLSKFSHDSDSEVAHNAIFAMGLVGAGTNNARLAAMLRQLAQYHAKDPNNLFMVRIAQGLTHLGKGTLTLCPYHSDRQLMSPVAVAGLMATLVGFLDVKNIILGKSHYLLYTLAAAMQPRMLVTFDEDLNPLPVPVRVGLAVDVVGQAGKPKTITGFQTHTTPVLLAHGERAELATEEYLSLTPIMEGFVILRKNPDFSP

SEQ ID NO: 12138 - protein, 509 aa, Ceutorhynchus assimilis
MADDGREKNPASGASEENDIEEGTYLMKMEPKEEPQASPQDVQPPKESEQDAAEVKLEKQEENNIKDEAKVLEEPPITEVIVESQPNITPPPSVIKKNVLTTAGKIESADHLEAHNEELVEAQESSDTEDKHRVPQEVVPYEIISQDSSTHSEHQFTVTSKSFNAGNFQQHLHQHHPHQHHQPEIFTLQITNSEGTTVPVTIESTIDTSADYANLETAQYSNNGQYPPDGSQYLQQHQYSTMQYQLERNSGESPPILNNNVLVRNNDPTLASSRYHQDLRFSASNYEQQLNQITLTAPQTGQTYQISPASAGSDSWSTSSTATTQYQQTYQGAANVSVHQADSSTAHQYYLNSNWPAGALEDGGNNVSAQRSPSSEANNRRNGVACANCKTLNTTLWRRNNQGEPVCNACGLYFKLHGVNRPISMKKEGIQTRKRRPKNNSSVHNGAGVSGMPQRLSNTQAIYYQNISQDQEIPIDQYQLPHTAVYQTQYHRPPQIQNAADHLGRQMAK

SEQ ID NO: 12139 - protein, 1661 aa, Ceutorhynchus assimilis
MALPSNGIFVVKGEMTILMTAIKRGIRWPSHSDEDTDNLLKNIQDLKDLLMKIDDLRLVEPDVFLAPFLEVIRSEDTSGPVTSLALAAVNKFLSYGLIDPTHPSVPNTVYNIADAVTHARFVGTDQSSDGVVLMRILQVLRTLTLAPEGAMLTNESLCEIMLSCFRICFEARIHELLKKTAEQYLKDMVQLVFMRLPQFSDDLRSSVKQLKMRAGMEHSRTKKRSRHSFRKKSAEVIEEKSKEAPTNVVDMQGQILQIDESPTTTVIEDNIDAEEKEGSLENNSEPIIQKPPSSEVLDTNETSKDYVNQRGIRFTPQLQDDLVLLPYGLACVRELFRFLISLCNPNDKQNTEVMIHLGLTLLTVAFEVGADSIGKHATLLALVKDDLARNLFSLLTNERISIFAADLQVSFLMFESLRIHLKFQMEKYLTKLIDIIVSDNQKINNYEHKEVALDNILQLWRIPGFVNELYLNYDCDMYCTNLYEDLTKLLAKNATNGIWHTHLMSLDALLTVIEGIEMHCFESKTKNIIGKTIRQNYSDNLPALDDLLARKNIKKWLPQGTEHFNTKPKKGIQFFQEHGVLKPELDPHEVAMFLRENPALDKKMIGEYISNRSNLNILEAFVKTFNFNGVRIDEALRSFLESFRLPGEAPTISLILEQFAEHWHQSNNEPFADVDSAFTLAYAVIMLNVDQHNQNAKKQSNPMSDSAFKKNLQGVNGGDNFEESMLNEIYHAIKGDEIVMPSEHGGLIRENYLWKVLLRKGASNKGDYFHIPPGTYDSELFRLIYDPIVSALCFIYEHTEEDSVYKHVVSGFEKCALVAAHFGMTANLDTLILSLCKFTVFYNQRRQNNIMILFGSNRKAQLALKTVFSLVHLNGDNIRQGWKYIFDLILALYSNNLLPKSYIEPEDFINQSGHIVLVYEETENLQKQESGLFSSIYSYMVSAENLSKIPSPEEQQFMDLAKECIKDCNLDQLITDSKFLHEEALVELVKCLIELSRGPDVQKSLGYNYNENVTVFFMELLFKIVIQNRDRVITIWQPVCDHIYTLVMNASVFDYQFLLERSVIGLLRIAIRLMRNEEMCPIVIQSLRMLLLLKSTTLCRISKQISYGLYELLKTSAQNIHTTTDWTIIFTLLECVGAGAQPPKPVADDGSTCADQSKSDGENQINSDEESVVSDRGYTSDSELTKKQKAILATSPCGTPNTGGWILVGNEGEIVGRTVPPTQYGIALERNLGPHDSMSLIKCCESLAFLVRDVAHITPYNFDICVQCIRTFVEASLQTDNKKRKRKVASRRKSELRSPAASSPSCSEDDDFPSGYHHLLLDLMHTLHTRTAQIFKWWAEEGGEIAQEMSLWTQGWCPLLQGIARMCCDRREEVRISAIAFLQRALLVHDLQTLNGLEWEQCFHRVLFPLLNYLLQPSGSKGPIAMAEFRNRAATVLSKVFLHHLTPLLSLPTFPNLWTNILDYMDRYMHADKSDILSEAIPELLKNMLLVMNSAKVFDNAEGKNQLWHHTWEKIGRFLPNLKEELFKEPVKLKPIIQDEMVSTPIGSTQTPSTSILQPTLQPGMPYMPNLLTSANQQQGQQHAFPVLYNSPTVIPSTTTTEIQPLSLYAEFLGNPYNLDKNLEAVDNAESNFFQSSNYFNNTIMPAGSEILFGMDKDCNN

SEQ ID NO: 12140 - protein, 205 aa, Ceutorhynchus assimilis
MSILAYNGGAMVAMKGENCVAIAADRRFGIQAQTLATNFEKVFEMGPHLYVGLPGLATDTQTVREKLRFRKNLYELKENRLMSPKVFSAMLSHMLYEKRFGPFFVEPVVAGLDPKTYEPFICNMDLIGCINQPKDFVVGGTASAQLYGMCEALWEPNLGPEDLFETISQALINAFDRDAVSGWGATVYIIEKDKVTIKNLKTRMD

SEQ ID NO: 12141 - protein, 936 aa, Ceutorhynchus assimilis
MEEKPNLDIVILAVSTLYKNPERTEKERASEWLLNLQKSVHAWSIADELLHKKPDLESCYFAAQTMRTKIHQSFHELPVEVHAALRDSLLEHISQINEGTNTVITTQLCLALSDLILQMPSWPCASLDLINRFSNHSYMWPLVEILTVLPEELEGRSVRLGENRRLEVLEDLKQCAPTVLEFLKHCCHTYGTNVNENTHIVARMLRCFNSWISVGAITLHGLSDNIVLNLAFDILDFRPHDGKESSGALCDAATECICTLLQCLEDNNNQQDLENYLFTNILKLEVSYHISVANEDQSKSIDYCRLFTELAESFLEKIVSNSTASNLHYAIKVLDMVLMCVGHHDYEVAEITFNLWYVLSEELYQKNNKELTELFRPYVERLITALCRHCQMEPDGDGILDEGDEFKDFRKKSSDLIKDVVFIVGSCSCFRQMFLNLQTPNVTWDQTEAALFVMQAVAKNVLPSENEVVPKVVEAILTMPQTTHLAVRHTSVLLLGELCEWIQKHSHVLDPVLNFLVSSLSARGLGAAAASALQNICIACNKCISRHMPILLQLLHQVDSFSITNNAIIGLLKGVASIVSVMPHSEITVVLRELCFMQLTPLVQVMEQTTLPVKGTTNDPILWLDRLSAILRHVIIVGVNENEVHPCKPVVLEIWPILLKATDKYQKDTRTMERCCRSIRFMLRCASQQVCEILESLVRQIIRLYNEHKHSCLLYVGSILVDEYAPNSQCVNGLLDMLQVFIEPTFHMLQQEDGLRNHPDTVDDFFRLCARFIQRAPVPLLRCNVLVPIIQCAMLAASLDHKEANMSVMKFFNDLINQGLTGHSLPDFAERHQLVKAILDQLGQQLVNALVQACVFYLHTYMLSEVGDVFVQLLDFNRENTSKWIAGALDNLPKQSNGGLMTATPEQLNEIHINLIRSSTSKSVTHSLKDLTRLYR

SEQ ID NO: 12142 - protein, 448 aa, Ceutorhynchus assimilis
MNTSGGTMIQRPSGAQYSPMRGQMQSQPGGKRPSDNRNSMQQKSDYGHITSKKKKKLADKILPQKVRDLVPESQAYMDLLAFERKLDATIMRKRLDIQEALKRPMKQKRKLRIFISNTFYPAKEPCPDGPDGPGAEGLVASWELRVEGRLLDDSKNDPNKVKRKFSSFFKSLVIELDKELYGPDNHLVEWHRTLTTQETDGFQVKRPGDKNVRCTILLLLDYQPLQFKLDPRLARLLGVHTQTRPVIISALWQYIKTHKLQDTHEREYIICDKYLEQIFNCSKMKFAEIPQRLNPLLHPPDPIVINHVISVEGGAESKQTACYDIDVEVDDTLKTQMNNFLLSTASQQEIQGLDSKIHETVDTINQLKTNREFFLSFAKDPQQFIHKWIVSQTRDLKTMTDVVGNPEEERRSDFFHQPWAQEAVCRYFYTKVQQKCAELEQALAIRNN

SEQ ID NO: 12143 - protein, 293 aa, Ceutorhynchus assimilis
MPSATISTLQLPNNEDCGIRDVWAHNLEDEFRTIRQIVQKYHYVAMDTEFPGVVARPIGEFRSSADYQYQMLRCNVDLLRIIQLGLTFLDDNGKTPGGSYTTWQFNFKFNLQEDMYAQDSIDLLTNSGIQFKKHEDDGIQPLEFAELLMSSGIVLMDNIKWLSFHSGYDFGYLIKLLTDSNLPPDENDFFDLLKLYFPAIYDVKYLMKSCKTLKGGLQEVAEQLELERVGPQHQAGSDSLLTGMAFFKMKEMFFEDTIDDSKFSGHLYGLGTSFAVNGSNNYGQDNGENTNST

SEQ ID NO: 12144 - protein, 401 aa, Ceutorhynchus assimilis
MAAKTQNAPFEDLSNVEFETSEDVEVIDTFSSMHLKEELTRGIYAYGFEKPSAIQQRAIKPIMKGRDVIAQAQSGTGKTATFSISILQSIDLTMRETQVLCLSPTRELAVQIQKVILALGDFMNVQCHACIGGTNLGEDIRKLDYGQHVVSGTPGRVYDMIRRRALRTRGVKMLVLDEADEMLNKGFKEQIYDVYRFLPPSTQVVLISATLPHEILEITSKFMTDPIRILVKRDELTLEGIKQFFVAVEREEWKFDTLCDLYDTLTITQAVIFCNTKRKVDWLTEKMRENNFTVSAMHGDMPQKERDNIMKEFRSGQSRVLITTDVWARGIDVQQVSLVINYDLPNNRELYIHRIGRSGRFGRKGVAINFVKSDDIRILRDIEQYYSTQIDEMPMNVADLI

SEQ ID NO: 12145 - protein, 534 aa, Ceutorhynchus assimilis
MTAPKASGDATRNRNLAYKDKSKPTDVRTSNINAAKAVCDAIRTSLGPRGMDKMIQAGNGQVTITNDGATILKQINVIHPAAKMLVELSRAQDVEAGDGTTSVVVIAGALLDAAERLLNRGIHPTAISESFQRAAVHALQILNNIATPVELNNREQLIKTAATSLNSKVVSQQSSQLAPLAVDAVLRIVEPGREAACNLSDIKVLKQLGGTVEDTELINGLVFPQKLANVSGPKRMEKAKIGLIQFCISPPKTDMDHNIVVSDYSAMDRVLKEERAYILNIVKQIKKAGCNVLLVQKSILRDAVSDLAIHFLDKIKCMVIKDIEREDIEFVCKTLSCRPIASLDHFVAENLVSAELVEEVGFGGNRMVKVTGIQNPGPTITLLVRGSNKLVLEEAERSLHDALCVVRCLVRKKAVIAGGGAPEIELALRLAALADKLEGVDAICLRAYANALEIIPFTLAENAGLNPIQTVTELRNRHAKNEVSAGINVRKGCISDILEENVIQPLLVTTSALSFATETVRSILKIDDIVNTMT

SEQ ID NO: 12146 - protein, 410 aa, Ceutorhynchus assimilis
MEAMDVVLPEKEEGSPSDNTKQSLQDADTEDLYTKYKKLQQMLEFLEVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVSYGDIGGMDMQKQEIREAVELPLTHFELYKQIGIDPPRGVLMYGPPGCGKTMLAKAVAHHTTAAFIRVVGSEFVQKYLGEGPRMVRDVFRLAKENSPAIIFIDEIDAIATKRFDAQTGADREVQRILLELLNQMDGFDQTTNVKVIMATNRADTLDPALLRPGRLDRKIEFPLPDRRQKRLVFSTITSKMNLSEEVDLEDYVARPDKISGADINAICQEAGMHAVRENRYIVLPKDFEKGYKNNIKKDESEHEFYK

SEQ ID NO: 12147 - protein, 140 aa, Ceutorhynchus assimilis
MPRIKLQSSDNEIFDIEVEIAKCSVTIKTMLEDLGMDDEEEEAVPLPNVNSAILRKVLQWATFHKDDPPPPEDDENKEKRTDDISSWDADFLKVDQGTLFELILAANYLDIKGLLDVTCKTVANMINRKSPRGDKKDFPH

SEQ ID NO: 12148 - protein, 330 aa, Ceutorhynchus assimilis
MENQQLEIDVQQSNSELPTMAVDDKASSKELDQWIEQLNDCKQLTENQVKTLCDKAKEILSKESNVQEVKCPVTVCGDVHGQFHDLMELFRIGGRSPDTNYLFMGDYVDRGYYSVETVTLLVALKVRYKERITILRGNHESRQITQVYGFYDECLRKYGNANVWKFFTDLFDYLPLTALVDSQIFCLHGGLSPSIDTLDHIRALDRLQEVPHEGPMCDLLWSDPDDRGGWGISPRGAGYTFGQDISETFNHSNGLTLVSRAHQLVMEGYNWCHDRNVVTIFSAPNYCYRCGNQAAIMELDDALKYSFLQFDPAPRRGEPHVTRRTPDYFL

SEQ ID NO: 12149 - protein, 837 aa, Ceutorhynchus assimilis
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGN

SEQ ID NO: 12150 - protein, 539 aa, Ceutorhynchus assimilis
MQPQILLLKEGTDTSQGKPQLISNINACQSIVDAVRTTLGPRGMDKLIVVRNGKATISNDGATIMKLLDVVHPAAKTLVDIARSQDAEVGDGTTSVVLLAGEFLKHIKPYVEEGVHPRIIIRSVRKCLQLCLAKINEISVKINKANVSEFRSLLEKCAATAMSSKLINQQRVFFSKMVVDAVLLLDELLPLNMIGIKKVQGGGLEDSMLVAGVAFKKTFSYAGFEMQPKIYKNCKIALLNIELELKAERDNAEVRVDNVKEYQKIVDAEWNILYKKLQKIHESGANVVLSKLPIGDVATQFFADRDMFCAGRVPDDDLRRTLKACGGAVMTTVNDINDSVLGKCDLFEERQIGGERFNFFKGCPNAKTCTLILRGGAEQFLEETERSLHDAIMIVRRTIQNDAVVAGGGAIEMELSKMLRDYSRTIAGKEQLLIAAIAKALEIIPRQLCDNAGFDATNVLNKLRQKHAQGHCWYGVDINKEDISDNFESCVWEPAIIKINALSAASEAACLILSVDETIKNEKSGGDQPQMGRGMGRPM

SEQ ID NO: 12151 - protein, 892 aa, Ceutorhynchus assimilis
MSKTKKFKKRYETDSSSSVDSEEEQRRKDLKERDEFADRLKKRDGEKTRNIIQASDRRAYEEAAKRLQLESAAREKIVPKLRVESRRKYLEKRKDDKLQELEADIVDDEYLFEEGILTEREKKERQHKKELLKLAQEHEKARELERVQRYHMPRDLGKDSTSDYIEVDELEKVPQSEQKKWEKDQMASAVFKFGAKDATKKDDYELVLEDQIDFIQALQMPGSRDKIKKEPELSEHEKKKLTIEETKKSLPIFPFKDDLMQAVREHQVLIIEGETGSGKTTQIPQYLHEAGFTEDGKKIGCTQPRRVAAMSVAARVAQEMGVKLGNEVGYAIRFEDCTSERTIIKYMTDGTLHREFLSEPDLQSYSVMIIDEAHERTLHTDILFGLVKDIARFRPDLKLLISSATLDAQKFSEFFDEAPIFRIPGRRFPVDIYYTKAPEADYVDACVISVLQIHVTQPLGDVLVFLTGQEEIETCQESLQDRLRRLGSKVRELIILPVYANLPSDMQAKIFDPTPPGARKVVLATNIAETSLTIDNIIYVIDPGFAKQNHFNSRTSMESLMVVPISKASANQRAGRAGRVAAGKCFRLYTAWSYKHELEENTVPEIQRINLGNAVLMLKALGINDLVHFDFLDPPPHETLVLALEQLYALGALNHHGELTKMGRRMAEFPVDPMMAKMLLASEKYKCSEEVVTITAMLSVNSSVFYRPKDKIIHADTARKNFYHLAGDHLSLLNVYNQWKDTDYSLQWCYENFIQYRSMKRARDVREQLVGLMQRVEIEMVSNVSETVDIRKAITAGYFYHIARLSKGGSYKTVKHNQSVTVHPNSALFEELPRWILYHELVFTTKEFMRQVIEIESKWLLEVAPHYYKPKELEDSTNKKMPKTVGRSTRTE

SEQ ID NO: 12152 - protein, 456 aa, Ceutorhynchus assimilis
MKVEEVKSTIKTQRISAHSHVKGLGLDENGFAIAQAAGLVGQEQAREAAGIVVDMIRSKKMAGRAVLLAGPPGTGKTAIALAIAQELGNKVPFCPMVGSEVYSSEIKKTEVLMENFRRAIGLRVRETKEIYEGEVCELSPVETEHPVGGQGKSVSHVVIGLRTAKGTKQLKLDPNIYEALQKERVEVGDVIYIEALSGAIKRQGRSDAFATEFDLEAEEYVPLPKGDVHKKKEVVQDVTLHDLDAANAKPQGGQDVLSMMGQLLRSKKTEITDKLRKEVNKIVDKYIDQGIAELVPGVLFIDEVHMLDIETFTYLHKALESAIAPIVIFATNRGRCLIRGTDDIYSPHGIPLDLLDRLLIIRTVPYDRPDMEQILKLRAKTEGLEIDDNALTALGAVGTKATLRYAVQLLTPAHLTAKGNKRTNITVADVEEVSFLFLDAKQSAKILSENSAKFMQ

SEQ ID NO: 12153 - protein, 735 aa, Ceutorhynchus assimilis
MTSIIKLQVLSGAMDESPPAYLLQIDDVKILLDCGWDEKFNMEFIKEVKRHIHQIDAVLISYPDTMHLGALPYLVGKLGLNCPIYSTIPIYKMGQMFMYELYQSQMNMKSFMLFNLDDVDATFEKIIQLKYNQSVPLKGKGYGLTITPLPAGHMIGGTIWKIMKAGEEDIIYANSFNHKKERHLNGCELEKLQRPSLFITDAFNASYQQARRRARDEKLMTNILQTLRNSGNVLIAVDTAGRVLELAHMLDQLWRNKESGLLTYSLALISNVAYNVVEFAKSQIEWMSDKLMRSFEGARNNPFQFKHLNLCHSLQELNKVPSPKVVLATSPDLEMGFARELFLQWCSNSNNSVIISTRTSPGTLARDLIDNNEPGRSIDLIVERRVKLEGQELEEYEKRQQMTKVEKTTKEDDSDSESDIEMSVISKGRHDIVVKQEGKVGGGFFKVTKKHHPMYPFKEEKIKCDEYGEIIRVEDYKLADITPEVEDNKENLQIKVEDVDEIIEVTDLPSKCIALERTVQVNCQVQYIDFEGRSDGESLIKILSQLKPRRVIVVHGTPENTEIIAKHCRENIGARVFTPQRGEIVDATSETHIYQVRLTDALVSQLQFQKAKEAEVAFVNANLQIRESQADARRLDADDEPMEVIEEDAHQLTLEPCNEDYSREPVFITELKLSDFKKVLAKANVPSEFSGGVLCCCNGTIAVRKLDTGKIVLEGCISEDYYKIKGLLYEQFAIL

SEQ ID NO: 12154 - protein, 741 aa, Ceutorhynchus assimilis
MSSSGEVGSSTSTQDAAPANPIVGIIYPPPEVRNIVDKTASFVARNGPEFEARIRQNELGNPKFNFLNSGDPYHAYYQHKVNEFREGKAQEPSLAQGISKLTVSASQQQKQHDILKQVEQPFVPKDPPSDFEFIADPPSISALDLDIVKLTAQFVARNGRTFLTQLMNREQRNFQFDFLRPQHSLFQYFTKLLEQYTKILIPPKTLQQKLRDEIVSHQTILDEVKYRAEYQKYQEAQKAREEEILERERVAYAQIDWHDFVVVEAVDYQAFEIGNFPPPTTPEEVGARILIQERIEDGEDIEMQLESDDDEPTNVDSGLSHMEDRTGPTSRKDNNQVQDMDEESSEEEYEREQPQPIQPPMPPALDKVVVKKYDPKKQTPKVTRPTPGDDYLVSPITGEKIPASKVQEHMRIGLLDPRWVEQRDKHVTDKMNQDTVYAQGPAIEASLKLLAERRTDIFGVGDEETAIGKKIGEEERRDEKVTWDGHTSSVEAATRAARANITLEDQIHQIHKVKGLLPDEEKEKIGPKNLQGSNKMKMPPAPIIKPPPPVLTAPSTTSIGIPVPPQPQIMVQPPIMMMPAPPMAPMRPPLMMPTHPPMAGFVTPMPPPMGLPPMPVKHPNDGPSEEEPSNKKLRNEDSLVPEEIFSARNPNPVNIKVAIPMMPDKPEWKLTGQMLSFTLPIGENVGNLKVKIQEEVSMPPTKQKLLFDGMFFKDQNTLAYYNITPGAVIQLQLKERGGRKK

SEQ ID NO: 12155 - protein, 321 aa, Ceutorhynchus assimilis
MPSQEVSTTKVVVHPLVLLSVVDHFNRMGKIGNSKRVVGVLLGCWRAKGVLDVSNSFAVPFDEDDKDKSVWFLDHDYLENMYGMFKKVNARERVVGWYHTGPKLNQNDIAINELVRRYCPNSVLVIIDAEPKDLGLPTEAYQAVEEVHDDGSPTSRTFEHVPSEIGAEEAEEVGVEHLLRDIKDTTVGTLSQRITNQLLGLKGLHSQLREIRDYLIQVSESKLPINHQIIYQLQDIFNLLPDINQLEFNKSFYVRNNDQMLVVYLSTLVRSIVALHNLINNKLTNKDAEEGKKEEKKDKDAKEKEKEKDKDKDSKKDEKKK

SEQ ID NO: 12156 - protein, 549 aa, Ceutorhynchus assimilis
MFGGGRAPILVLSQNTKRESGRKVQLENINAGKQIADVIRTCLGPQAMLKMLMDPMGGIVMTNDGNAILREITVQHPAAKSMIEIARTQDEEVGDGTTSVIVLAGEMLAAAEQFLEQQIHPTVIIRQYRQALEDIISLIEGPLSVPIDKNDKAALSNVVRGCVGTKFIGKWSDLAVKIALDAVHTVMLEENGRTEVDIKRYAKVEKIPGGSIEESEVLTGVMLNKDVTHPKMRRYIENPRIILLDCSLEYKKGESQTNVEITSDGDFTRMLQLEEEHVRRQCDEVIALKPDLVFTEKGVSDLAQHFLLKAGISAIRRVRKSDNNRIARACGATIVNRTEELQESDVGTGAGLFEIKKMGDEYFCYITKCKNPKACTIILRGASKDILNETERNLQDALQVARNIVLSPRLVPGGGAIEMAIAQKLLQKATHGPYRSLAHALEIIPRTLAQNCGANTIKTLTALRAKHANHTDVNSPCTWGIDGESGELVEQKERGLWEPLAVKLQTYKTAIETAILLLRIDDIVSGSKKKDREPAGPAQTQETAAMMQD

SEQ ID NO: 12157 - protein, 232 aa, Ceutorhynchus assimilis
MSLVVKPNFPDYQTAPVQRGFNPYADNGGSVVAIAGDDFVIIGADTRLSAGFSIYTREQNKLFPLSSTTVLGCSGCWCDTLTLTRILKSRMQMYQQEHNKTMSTTACAQMLSTMLYYKRFFPYYISNVLVGLDNDGKGVVYSYDPIGHCEKRTHRAGGSAGALLQPLLDNQIGKKNMLNVKEEPVSQQRALSIIKDVFISAAERDIYTGDSILINIITKDGIKEETFQLRKD

SEQ ID NO: 12158 - protein, 330 aa, Ceutorhynchus assimilis
MSSRRNRFVSRRINIQNAAAREFQFGFNMFPDIPRPFNVTYQCYSVAMLPGNERQDVERGGKIIMPPSALEQLTRLNINYPMLFKLTNKNSGRETHCGVLEFVADEGKVYLPLWMMHNMNLEEGELVQMESVSLPVGTFSKFQPLSPEFLDITNPKAVLENCLRSFACLTKGDVIAVQYNQKIYELCVLETKPGNAISIIECDMNVEFAAPVGYKEPEIVRKPEEEMAVDPAELMPEPTGFIAFKGAGNRLDGKKRKDSTSTDVSPHKPIYVRGIPDYDYEIGSLRFIRAIAKPKNNDNNESDEFKPFSGEGFSLKDSAYLLFVIIIIFF

SEQ ID NO: 12159 - protein, 542 aa, Ceutorhynchus assimilis
MAGFPGSIAFDEYGRPFIILRDQDKQKRLTGIDALKSHILAARQIANTVRTSLGPKGLDKMMVSPDGDVTVTNDGATILKMMDIEHEIGKLLVELSQSQDDEIGDGTTGVVVLAGALLEQAASLVDRGIHPIRIADGFEMACQTAVAHLEKIAELFPVSATNPEPLIQVAMTTLGSKIINKCHRQMAEIAVNAVLAVADLEQKDVNFELIKVEGKVGGKLEDTVLVKGVVIDKTMSHSQMPKELKDVKLAILTCAFEPPKPKTKHKLDVGDVAAYKELRQYEQEKFKEMVNLVKNAGATLAICQWGFDDEANHLLLQQQLPAVRWVGGPEIELIAIATGGRIVPRFEELSPEKLGTAGLVRELSFGTTSDKMLVIEECANSRAVTILVRGGNKMLIEEAKRSLHDALCVVRSLVQEPNIVYGGGAAEIACSLAVAAQADQLASLEQYAYRGFAEALEAIPLALAENSGLSAIHTLGELKAKQSASGDPALGIDCMFTGNMNMREQHVIESLKSKRQQLLLATQLVKMILKIDDVRSPSDQQG

SEQ ID NO: 12160 - protein, 115 aa, Ceutorhynchus assimilis
MASASAMDVDTDEVEMPTSSSSKGEKKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 12161 - protein, 534 aa, Ceutorhynchus assimilis
MVSLNPVRVLNQNAEEERAEIARMSSFIGAIAIGDLVKSTLGPKGMDKILVSSGRNAGSVEVTNDGATILKSVGIDNPAAKVLVDMSKVQDDEVGDGTTSVTVLAAELLREAEKLVDQKLHPQIIIAGWRKASDIARKALEDASEDNSASSEKFREDLMNIARTTLSSKILSQHKEHFANLAVDAILRLKGSGNLQAVQIIKKSGGTLEESFLEEGFLLDKKPGVHQPKRVENAKILIANTPMDTDKIKVFGSTIKVDSMAKIAELELAEKEKMKDKVNKILKHNANVFINRQLIYNYPEQLFADAGVMAIEHADFDGIERLALVTGGEIVSTFDQPESVKLGTCDLIEQIMIGEDILLRFSGVALGEACSIVIRGATHQIIEEADRSLHDALCVLAATVKEHRVVYGGGCSETLMAVAVSKAALNTPGKEAVAMEAFARALLQLPTIIADNAGYDSAQLVAELRASHNNGNSFDGLNMEKGEIGDMRALGITESFAVKRQVLLSASEAAEMILRVDNIIRAAPRRRVEDRGHC

SEQ ID NO: 12162 - protein, 279 aa, Ceutorhynchus assimilis
MFRNQYDSDVTVWSPQGRLHQVEYAMEAVNLGSATVGLKSNSHAVIIALKRASSELSAYQKKIINIDDHIGITISGLTADARILSRYMRTECLNYKYSHDTYMPMNRLITTLGNKMQVCTQRYDRRPYGVGLLVAGFDDKGSHIYQTCPSANFYDCKAMSIGSRSQSARTYLEKHLDQLLNSSLEELIKHGLRALRDTLPPEIDLSTKNVSIGFVGKERQFKILEEEEIAPYLGLIEGEERRGQGADKAPGPLREDQGEAPRDPQAATATEAADRMDTD

SEQ ID NO: 12163 - protein, 849 aa, Ceutorhynchus assimilis
MKMPVRNQISEFMPMVIVFSDDELPYEEEILRNPYSVKHWLRYIDHKKQSPNLIYERALKQLPGSYKLWYNYLLIRRQQVKSKCLLDPDFEAVNNCFERSLVFMHKMPRIWMDYCQFLTDQNKITRTRKVFDRALRALPVTQHHRIWPLYLKFVSKHDIPETSVRVFRRYLKLFPENREEFVEFLQKIDRLDEASVILAKCVNNDNFISRNGKSKHQLWNELCELMSNNPQKILTLNVDAIIRGGLRRYTDQLGHLWTSLANYYVRSGLFDRARDIFEEAIQTVTTVRDFTQVFDAYAQFEELSLSKQMEEVAKIAEPTDDDNVDLELRLARFEHLMERRLLLLNSVLLRQNPHNVQEWHKRVQLYDGQPHEIINTYTEAVQTVQPKLAVGKLHSLWIAFAKFYEQNSQCEDARLIFEKATEVEYIKVDDLATVWCERVELEIRQENYEEALKLMYRATAMPKRKVAYFDEKESVQARLYKSLKIWAMYADLEESFGTFKSCKAVYDRILDLKIATPQIIINYGMFLEENNYFEEAFRAYEKGISLFKWPNVYDIWNTYLTKFLKRYKGDKIERARDLFEQCLETCPEAYCKNLYLLYAKLEEDYGMAHHAMAVYERATQAVSQDSMLEIFNIYIKKASSIYGIPKTRQIYEKAISVLPEKDIRDVCLRFADMETKLGEIDRARGVYSHCSQICDPRITGEFWQTWKEFEVKHGNEETMREMLRIKRSVQATYNTQVNMMSVQMLGSSSPLGTTADLAPGEKDGMRLLEVRAAEMASSSGAQKSATSGIMFVRGETQGGKKDKVVNPDEIDIDADGGEDEDGEDDEDPEPLLEQIEVPQEVFGSLKKPD

SEQ ID NO: 12164 - protein, 362 aa, Ceutorhynchus assimilis
MANGPIAERNRDATIYVGGLDEKVVDSLLWELFVQSGPLVNVHMPKDRVTMMHQGYGFVEFMGEEDADYAIKIMNMIKLYGKPIRVNKASAHQKNLDVGANIFIGNLDLEVDEKLLYDTFSAFGVILQTPKIMRDPESGNSKGFAFVNFANFESSDASIEAMNGQYLCNRPISVSYAFKKDSKGERHGSAAERILAAQNPLSQADRPHQLFADSPPIGMMPPGMTTAPPPPPGMLGLPPPSVTPNTTIPPPPPAVPPPASFPAGIPPPPLPPSQPPLPPIAPPPPPASKPGVMNPPAPWKGGLGNPPPPPVPPVSDPNFSKLLLPPPPPSGPPQKWEGPPPSAISGRPSFPPRRPPPPPPTN

SEQ ID NO: 12165 - protein, 231 aa, Ceutorhynchus assimilis
MGRVIRAQRKGAGSVFKSHTKKRKGAPKLRYLDFSERHGYIKGVVKDIVHDPGRGAPLAFVHFRDPYKFKTRKELFIAPEGMYTGQFVYCGKKANLQIGNVLPVGTMPEGTIVCNLEEKTGDRGRLARASGNYATVIAHNHDTKKTRVKLPSGAKKVIPSNNRAMVGIVAGGGRIDKPILKAGRAYHKYKVKRNCWPKVRGVAMNPVEHPHGGGNHQHIGKASTVKRGTSA

SEQ ID NO: 12166 - protein, 136 aa, Ceutorhynchus assimilis [sequence omitted]

SEQ ID NO: 12167 - protein, 531 aa, Ceutorhynchus assimilis
MAISLLNPKAEVARAAQALAVNISAAKGIQEVMKSNLGPKGTMKMLVSGAGDIKITKDGNILLHEMQIQHPTASLIARASTAQDDMTGDGTTSTVLLIGELLKQADIYIAEGLHPRLLAEGFDKAKTKALEVLDKIKIPIEINRENLLDVCRTSLRTKVHQTLADVLTEVCVEAVLAIRPKDNKPVDLHMVELMQMQHKTETDSSLIKGLVLDHGSRHPDMPKRLENCYILTCNVSLEYEKSEVNSGFFYKTAEERDKMVLAEREFIDQRVKKVIELKKKICTGTNKTFVIINQKGIDPMSLDQLAKEGIIALRRAKRRNMERLSLACGGTAMNTFDDLSESCLGYAGLVYEHVLGETKFTFVEECKNPQSVTILLKGPNKHSLQQIKDAIRDGLRAINNAIEDKAVIPGAGAFEIAANKELLQWKDTVKGKTRLGVVAYAEALLVIPKILATNSGFDVQETIVKLQEESHTSPEPIGLDLTSGEPISPKDAGIFDNYIVKKQIINSCSVIASNLLLVDEIMRAGMSSLKG

SEQ ID NO: 12168 - protein, 1046 aa, Ceutorhynchus assimilis
MSSAENADSSVDPPTKKRKLEARKSTNTDREMANNGTASSSQAQGQTSEIDEGLYSRQLYVLGHDAMRRMATSDVLISGLGGLGVEVAKNVILSGVKSVTVHDDKEATITDLSSQFFLSEEDVGSNRAEVVCKKLAELNSYVPTRSYTGSLDEDFIKKFRVVVLTNSTSSEQLRISEITHANNIALIIADTRGLFAQVFCDFGESFTVVDATGEPTVSAMIADISNDTEGVVTCIDDTRHGMEDGDFVVFSEVQGMTELNGCSPIKIKVLGPYTFSIGDTTAFSKYQRGGIATQVKMPKELHFKSLKESLGNPEFLMTDFAKFDYPPQLHLAFSTLHAFEEKNGRVPKPWSNDDAAEFVALAKTNASSGDTEINAGLLETFAKVCAGNLNPINATIGGIVAQEVMKASSGKFHPIVQWLYFDAIETLPSDRSEITEESAAPQGTRYDGQIAVFGKEFQNKIAAQKYFVVGAGAIGCELLKNFAMMGLGTEGCIIVTDMDLIEKSNLNRQFLFRPHDVQKAKSDTAALAILKMNPQINIVAHQNRVGPDTESVYDDEFFENLDGVANALDNVDARIYMDRRCVYYRKPLLESGTLGTKGNTQVVVPFLTESYSSSQDPPEKSIPICTLKNFPNAIEHTLQWARDAFEGLFNQNIEKAYQFLSDPDFLERTLKLPGVQPLETLEQVKAALVDERPKSFDQCIAWARLYWEDQYNNQIRQLLFNFPPDQLTSTGQLFWSGPKRCPQPLTFDINDPLHIDYIAAAARLKADCYGIPHAHANRDHIAQVAASIEVPVFVPRSGVKIAVTDSQMAANGNNVDLDRITQLTQEIPTRDKIDGVMLKPLDFEKDDDTNFHMDFIVAASNLRALNYKIPPADRHKSKLIAGKIIPAIATTTSVVAGLVCLELYKLIRSQRSLEPFKNGFVNLALPFFGFSEPIAAPQKEYGENKWTLWDRFEIDGEMTLAEFLQYFKDKHNLEITMLSQGVCMLYSFFMQKAKAQERLGLSMSEVVRRVSKKKIEPHVKALVFELWCNDTEGEDVEVPYVKYNLP

SEQ ID NO: 12169 - protein, 423 aa, Ceutorhynchus assimilis
MADAEDLLDYEDEEQNEQTPAEAAAEPKKAVKGTYVSIHSSGFRDFLLKPEILRAIVDCGFEHPSEVQHECIPQAVLGMDILCQAKSGMGKTAVFVLATLQQLEPTENQVYVLVMCHTRELAFQISKEYERFSKYMPTIKVGVFFGGMPIQKDEDVLKNSCPHIVVGTPGRILALVRSKKLNLKNLKHFVLDECDKMLELLDMRRDVQEIYRNTPHGKQVMMFSATLSKDIRPVCKKFMQDPMEVYVDDEAKLTLHGLQQHYVKLKENEKNKKLFELLDILEFNQVVIFVKSVQRCVALAQLLTEQNFPAIGIHRGMDQKERLSRYEQFKDFQKRILVATNLFGRGMDIERVNIVFNYDMPEDSDTYLHRVARAGRFGTKGLAITFVSEESDAKILNEVQDRFDVNITELPDEIDLSSYIEGR

SEQ ID NO: 12170 - protein, 490 aa, Ceutorhynchus assimilis
MVSVENDVEMKNADSPPGPEAGDSKRDADLQSLQEIREHTRQIEKAISNKESRFILRVLRCLPNTRRKLNGVVLRSLITQIYPAADREALLVFVEEAVGEIESSQTRIRSATKAALPEVDSYINLLILVRLIDTNKLEEAQRCSQALMNKIVSQNRRTIDLIAAKCYFYHSRVAELSNKLDTIRAFLHARLRTATLRNDFEGQAVLINCLLRNYLHYSLYDQADKLVSKCVFPETASNNEWARFLYYLGRIKAARLEYSVAHKHLVQAMRKAPQNTAVGFRQTVQKLLVVVELLLGDIPERQIFRQPAMRHSLSSYFQLTQAVRMGNLQRFGEVLENFGPQFRQDHTYTLILRLRHNVIKTALRSIGLAYSRISLQDIAQKLGLDSAEDAEFIVAKAIRDGVIEATLDAEGGYMRSKETTDIYCTKEPQMAFHQRISFCLDLHNQSVKAMRYPPKAYGKELESAEERREREAQDLELAKEMAEEDDDGFP

SEQ ID NO: 12171 - protein, 545 aa, Ceutorhynchus assimilis
MAHTSQSLPVSQILKTKTNDIEDDDEPKKKSREDWRKAKELEEARKAGTAPAAVDEEGKDINPHIPQYISNAPWYYGTSGPTLKHQRPQEEHQKQFSGLDEWYQRGLDTSKIVTKFRKGACENCGAMTHKKKDCMDRPRKIGAKYSKSNILPDEYVQKNLALSFDGKRDRWSGYDPSEHKTVIEEFQKVEEAKRQLKAEKLDAENSDEEEKDEDKYVDEVDMPGTKVDSKQRITVRNLRIREDTAKYLRNLDPNSAYYDPKTRSMRENPNPGVDETHQGENFIRFTGDTKNHAKAQLFAWEAYEKGVDVHLLAEPTKLELLKKEYEKKKEQFKDTVSSSVLDKYGGEEHLKAPPKTLLLAQTEDYVEYSRSGKIIKGQEKEEIKSKYEENVYINNHTSVWGSYWKGGHWGYKCCHSFIKSSYCLSEAGKSIEQPMPETVPNEVLEKVASEKSESSSSSEEDVRTASEKSSKKKKTKKIKKKDKDKLAEALKAEEQQQQQADHLLSIDERKRPYNSMFEAKKPTEEEIEAYYLKRRREDDPMNQFM

SEQ ID NO: 12172 - protein, 208 aa, Ceutorhynchus assimilis
MGISRDHWHKRRATGGKRKPLRKKRKFELGRPAANTKLGARRIHYVRTRGGNIKYRALRIDTGNFAWASEGTARKTRIIDVVYNASNNELVRTKTLVKNAIVVVDATPFRQWYETHYILPLGRKKGAKLTAEEEAILTKKRSKKVQKKYENRQKIAKVEPAIEEQFQTGRLLACLASRPGQCGRADGYILEGKELEFYMRKIKSKKAK

SEQ ID NO: 12173 - protein, 311 aa, Ceutorhynchus assimilis
MDRLLRLGGGMPGLSQAPPPNDAPVVDTAEQVYISSLALLKMLKHGRAGVPMEVMGLMLGEFVDDYTVRVIDVFAMPQTGTGVSVEAVDPVFQAKMLDMLRQTGRPEMVVGWYHSHPGFGCWLSGVDINTQQSFEALSERAVAVVVDPIQSVKGKVVIDAFRLINPNMMVLGQEPRQTTSNLGHLQKPSVQALIHGLNRHYYSISINYRKNELEQKMLLNLHKKSWMDGLMLADYSENCSTNEKTVAEMLELAKNYNKALEDEEKMTPEQLAIKNVGKQDPKRHLEEKVDVLMTNNIVQCLGAMLDTVVFK

SEQ ID NO: 12174 - protein, 404 aa, Ceutorhynchus assimilis
MTVINKMEIDGGSKGEGFRSYYITKIEELQLVVAEKSQNLRRLQAQRNELNAKVRMLREELMLLQEQGSYVGEVVKPMDKKKVLVKVHPEGKFVVDIDKNIDINDVTPNCRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 12175 - protein, 199 aa, Ceutorhynchus assimilis
MVKLYCISILYKGPTSATWLKSAYDLQSFSYFQRGSVQEFMLFCAKTIAERTIPASRQSVKEGEYFCHVYVRADNLAGVIISDQEYPSRVSHTLLTKILDDFADKIPSTSWPNLQERDVAFPQINTYLAKYQKPAEADILTKIQGELDETKIILHNNIAAVLDRGEKLDDLVSKSEGLSIQSKAFYKTARKTNACCSFS

SEQ ID NO: 12176 - protein, 256 aa, Ceutorhynchus assimilis
MFLTRSEYDRGVNTFSPEGRLFQVEYAIEAIKLGSTAIGISTSQGVVLAVEKRITSQLMEPTTIEKIVEVDKHIGCAVSGLIADSRTMIDRARIECQNHWFVYNENMTVESCAQAVSNLAIQFGDSDDDGAAMSRPFGVAILFAGIDEKGPQLYHMDPSGTFVQFDAKAIGSGSEGAQQSLQEVYHKSMTLEEATTSALTILKQVMEEKLNSSNVEVMTMTPDKLFHMFSKDQVEEALTRGLLVEHPVTLTVGQKA

SEQ ID NO: 12177 - protein, 386 aa, Ceutorhynchus assimilis
MTEYWLISAPGDKTCQQTWETMNNMTSKQNSLCTNYKFHIPDLKVGTLDQLVGLSDDLGKLDGFVEQVTRKVASYLGEVLEDQRDKLQENLMANNTDLPSYLTRFQWDIAKYPIKQSLRNIADIISKQVGQIDADLKTKSTAYNNLKGSLQSLEKKQTGSLLTRNLADLVKKEHFILDSDYLQTLLVIVPKAQVHEWNATYEKITDMIVPRSSQMVTQDNEYGLFTVTLFKKVMDEFKHHAREKRFIVRDFTYDEEQLAAGKNEITKLATDKKKQFGPLVRWLKVNFSECFCAWIHVKALRVFVESVLRYGLPVNFQAILIHPNKKSMKRLRDVLNQLYGHLDGSVGHQGSNVDNVDIPGLGFGQSEYYPYVSYKINVEMIESKTL

SEQ ID NO: 12178 - protein, 557 aa, Ceutorhynchus assimilis
MSILASPLSVAGQRTSGAPVRTQNVMAAAAIANIVKSSLGPVGLDKMLVDDIGDVTVTNDGATILKLLEVEHPAARILVELAQLQDEEVGDGTTSVVIIAAELLKNADELVKQKIHPTSIISGYRLACKEACRYIQDHLTIPVEDLGKEYIINVAKTSMSSKIIGADADLFSAMVVDAAYAVKVTDVKGNPLYPIKAVNVLKAHGRSARESTLIQGYALNCTVASQAMPKKIVGAKIACLDFSLQKAKMKMGVQVLINDPDKLEAVRARELDITKERIQKVLSTGVNVILCSGGIDDLCLKYFVEAGAMGVRRVKRVDLKRIAKATGATFLTSLSNMDGEESFDANMVGEAAEVLQERISDDELIIIKNPKQRTAASIILRGPNDFYCDEMERSVHDALSVVKRVLESKSVVVGGGAVEAALSIYLENFATTLSSREQLAIAEFARTLLVIPKTLAVNAAKDATDLVAKLRAYHNSSQTKLEHADLKFVGLDLIEGTVKDNRKAGVLEPTVSKIKSLKFATEAAITILRIDDMIKLDAQEKGGRSYQEAYQSGQLYD

SEQ ID NO: 12179 - protein, 254 aa, Ceutorhynchus assimilis
MFSAPPFWQNGPAPGSFYDFPNMQPQVQPNDFRQHTQSPVTTSTSLVAVTYDKGIIIAGDLLASYGSLARYRNCPRIVKVNNNIILGSSGDYADFQYVQNFIEQKVISDECLDDGITLKPKSLYCWLTRILYNRRSKMDPLWNNFIVAGIQDGEPFLGTVDKQGTAYSDKIICTGYGAHIATPMLRDALDNKPQLTQAEARAQVERCMEVLYYRDARSFPKYQLGIIDADQGVSIEGPLQVAQNWSVAHSIKGY

SEQ ID NO: 12180 - protein, 682 aa, Ceutorhynchus assimilis
MDIPKEPNFSLLSSQDFAPEKYVRDISQNYVGGLELQNIKKKIQALADETSNNLKKNVYQNYVQFIETAKEISHLESEMYQLSHLLSEQKGLLTALSTSSILEDNRAHFDVRNEKLDEQELEEENKQKLATILDKVENCKEVVEAPDRFLLFEGDLLEIDATENTAIKFVHVYLFNDSLMLTNRNSNSRGLMRYAFESLYELSSLAVVNVRDLGNIKHAFKLLIFPDTRVFQCSSNASKKEWLDKIDQAKKTRLVQEQQKRESSLEKISPARSISVDLNINSQPEEIFTHPDWFLDIPDELDVCIAQRQFEDAVNHINKSKTYINKHPEYVGAIQKKIDQKQNTLVEMLMKELEVNPEKSLQGGLRATRTAVRLLNQLGRSTQSCDLFLKLCSSMLKIQCKRVKREGSTSTYVRHLSSVVFTNMCHMSEEFLRAFPDSCANCASAYVVWASGELSLFTTHFAKQVFMPQTSLSTITECVVLVRSQCERLCTYGVDFRYQLDGALRAPLSKALNDARDKFVDSIKLRAIDEKWIPVNLNTRSGLARCLQEYAVLGLKLDTYVTGDVWLQLTSSNLAFTKSFLILLDDCLKLKTTELLHSIDETLAKCFEAQLRYNEQGLKNEDQKQFILKNFEFLLVVLVQLTQTKYKEATGYECDNLNKLVNDYLSLLKARSTKTKYSSEFL

SEQ ID NO: 12181 - protein, 1224 aa, Ceutorhynchus assimilis
MDKMDEVEKLEYLSLVSKICTELENHLGASDKDLAEFIIHLSEKNNTNDSFKKALIEAGAEFADSFISNLLRIIQHMRPRKDQSKDEIVQEEKSELAQKFPGLAIPNEPQKPLGDDENIDSKLENSNKAKKQDNDVVADLMAQFEAEAPSASTNSKTEKSRKRSRSRNRSRSKNRSRSRERRRDRSRDDKKGRYRDRSRDRHRERDRDRERDTERRRERHRSRSRERRRSRDRRDRSRSRSRTRRGREDDFDKKNKFDKGSVELDEDPVVGKVYNAKVANIVPFGCFVQLEGLKRRWEGLVHISQLRGEGRVTQVSEVVSRGNKVKVKVLSVTGQKVSLSMKDVDQLTGKDLNPLHAPQEREDKDRNPDRPTYNSTSVLKLALPLEENEDGTRKRVTRISSPERWEINQMIASGSIDKSELPDFDDETGLLPKDEEDGEADIEIELVEDEPPFLHGHGRALNDLSPVRIVKNPDGSLAQAAMMQSALAKERREHKMLQREAEVDSQPSGKSKSWIDPLPDEENKPAAPRGIGLQSQDLPEWKKHVIGGKKSSFGKKTNLTILEQRKSLPIYKLKEELRKAVTDNQILIVIGETGSGKTTQITQYLAEEGFTARGRIGCTQPRRVAAMSVAKRVAEEYGCRLGQEVGYTIRFEDCTSPETIIKYMTDGMLLRECLMDLDLKGYSVIMLDEAHERTIHTDVLFGLLKQAVTKRSELKLIVTSATLDAVKFSQYFFEAPIFTIPGRTFPVEVLYTKEPETDYLDASLITVMQIHLREPPGDILLFLTGQEEIDTACEILYERMKSLGPEVPELIILPVYSALPSEMQTRIFEPAPPGSRKVVIATNIAETSLTIDGIFYVVDPGFVKQKVYNSKTGMDSLVVTPISQAQAKQRAGRAGRTGPGKTYRLYTERAYRDEMLPTPVPEIQRTNLATTVLQLKTMGINDLLHFDFMDAPPVESLIMALEQLHSLSALDDEGLLTRLGRRMAEFPLEPNLSKMLIMSVALQCSDEILTIVSMLSVQNVFYRPKDKQAVADQKKAKFNQPEGDHLTLLAVYNSWKNNKFSNAWCYENFVQIRTLKRAQDVRKQLLGIMDRHKLDVVSAEKNTVRVQKAVCSGFFRNAGKKDPQEGYRTLVDSQVVYIHPSSALFNRQPEWVIYHELVCTTKEYMREVTTIDPKWLVEFAPAFFKFSDPTKLSKFKKNQRLEPLYNKYEEPNAWRISRVRRRRN

SEQ ID NO: 12182 - protein, 421 aa, Ceutorhynchus assimilis
MAPHRRNIDDVLARINFPLFTLQMLTNRHVLVGGGGGSSKTGVANGFEIFELSHDGKKFHVEEVTRHETGPNVVMNCSVSSSPDKKHTYLVAGQESHCQLYHVNTDFAAQLNGSVETIGNNHEDTGELRQRKNKTNNNKNTKKRLKFVLSPGDSVQTDFNGTEPLCRVVRLHPNGKLMASGGTDGDIRMWKFPGLEPLAKLKAHTKEIDDIDFSSFGNLLITIAKDGLAVLWDCVKGTEIKRLKWEQPQGSKYLYKRCRFGSIEGQQKSALYMLANPTGVAKRQKSYLQQWYPEEGILKRVTEFDESLSALAVRDDGRFIAVGTMFSGSVSIHVAFSLQRVLNVAGAHSMFVTGLEFLPVSNPENHTVCSVAEAAVLSISVDNQVCIHTLPYRKSIPLWLAIVILIFAMFLTFVFCSYIGL

SEQ ID NO: 12183 - protein, 407 aa, Ceutorhynchus assimilis
MSGATLFERPGSELFKHKENDENDERNIQNKEQDILNLGEKYKNEGKAKELADLIKQTRPFLSEISKAKAAKLVRSLIDFYLDLEAGTGLEVQLCKECIEWAKEEKRTFLRQSLEARLVALYFDTGMFSEALQLGSTLLWELKKLDDKNLLVEVQLLESKIYHALSNLPKARAALTSARTTANTIYCPPKIQASLDLQSGILHAADEKDFKTAYSYFYEAFEGFDSVESSKALTALKYMLLSKIMLNHSEDVQQIVSEKLAIKYAGRDIDAMKAVAQASHKRSLADFQVALKQYKAELEDDVIVRAHLDTLYDNMLEQNLLRIIEPYSRVQVDYIAKAIKLSMAQVEQKLSQIILDGKFDGILDQGEGVLIVFDEAPVDKSYEMALETIHNMSKVVDTLYQKAKKLL

SEQ ID NO: 12184 - protein, 589 aa, Ceutorhynchus assimilis
MATRAKKSATPGSQPPPRAQSPLSPTRHSRLQEKHDLQNLNDRLATYIEKVRFLENENLKLTKEVQCHQETSQREVSHIKSMYDHELGEARRLLDATHSEKSRLEIDLKRVLEENDDLKADLAKKTKDLVVAENAARVYETRCNDLQLKYTQANADAKKAIGDLKDLEKERDKLKKMLDEHRKQLEEESLARVDVENANQTLREELSFKDQVFQQQLTETRTRRQVEITEIDGQLAEQYEAKLQQALQDLRDQYEAQITNNRAEIENMYDSKIKSLQTAANRHSAAAANALDEARQVRTRIDTLSSRVTQLENENGALVARSRDLEKILEHERLRHAEELAALEGELSRMREEMNVQLQEYQDLMDIKVSLDLEIAAYRKLLESEEDRLKITPAGQERDVSHSSSRSLAQRYTPSRHNTKRKRFLMEESQDSSLSDFSVTTSCKGDIEILEADPEGRFVKLVNKSNQEVSLGGWQLLRKAGTEETKFKFNRSLKLEGKGTVTVWSADLNKDHEPPHNLVMKGQKWLVGDNMTTVLVNLDGEEVATSERIKTQVSTSHLRHRESAGGFIEGEDLHQHVGDPQGDEKCRLM

SEQ ID NO: 12185 - protein, 808 aa, Ceutorhynchus assimilis
MADQQNDDLATAILRKKDRPNRLIVEEAVNDDNSVVALSQAKMDELQLFRGDTVLLKGKRRKETVCIVLSDDTCSDEKIRMNRNVRNNLRVRLSDVVSIQPCPDVKYGKRIHVLPIDDSVEGLTGNLFEVYLKPYFLEAYRPIHKDDVFIVRGGMRAVEFKVVETDPAPFCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDAALRRFGRFDREIDIGIPDATGRLEILRIHTKNMKLADDVDLEQIAAETHGHVGADLASLCSEAALQQIREKMDLIDLEDDQIDAEVLNSLAVTMENFRYAMTKSSPSALRETVVEVPNVTWEDIGGLANVKNELQELVQYPVEHPDKFLKFGMQPSRGVLFYGPPGCGKTLLAKAIANECQANFISVKGPELLTMWFGESEANVRDIFDKARSAAPCVLFFDELDSIAKSRGGNVGDAGGAADRVINQILTEMDGMGAKKNVFIIGATNRPDIIDPAILRPGRLDQLIYIPLPDEKSREQIFKANLRKSPVAKDVDMVYIAKVTHGFSGADLTEICQRACKLAIRQSIEAEIRRERERAANPAAAAAMDLDEDDPVPEITRAHFEEAMRFARRSVSDNDIRKYEMFAQTLQQSRGFGTNFRFPSSQGAPAQGGQVPPPVAPGDQANFDDPEDDLYS

SEQ ID NO: 12186 - protein, 274 aa, Ceutorhynchus assimilis
MGDQFDCALDLMRRLPPQQIEKNLSDLIDLVPSLCEDLLSSVDQPLKIAKDKETGKDYVLCDYNRDGDSYRSPWSNTYYPPLDDGQMPSERLRKLELDANHAFDQYREMYFEGGVSSVYFWDLDHGFAGVILIKKIGDGSRKIKGCWDSLHVVEVQEKSSGRNSHYKMTSTAMLWLQTNETGSGTMNLGGSLTRQIEQDSAVNENNPHIANIGRMVEDMENKIRNTLNEIYFSKTKDIVNSLRSVQPLTESRQKEILKQDLAAALQKRHNKSDN

SEQ ID NO: 12187 - protein, 1331 aa, Ceutorhynchus assimilis
MQQVEAAAQNNNTGKMNEQASAGNGAAAVPAQSATPSNAIARDNREPPPRNEPPVEPVDGVVQPNVIPQADRPGRVTNQLQFLQKTVLKAVWKHQFAWPFQQPVDAKKLNLPDYHKIIKQPMDLGTIKKRLDNIYYWSGKECIQDFNTMFTNCYVYNKPGEDVVVMAQTLEKVFLTKVADMPKEEIIVESQMKSAKGKKGRASSVGATTPTATIIGTPSRGRPPVTVSSTVSNPFATTTGSMGLPLGTAAPATVPGSTATTTIAPPINVNSQATPIIPAPTYAPPPLDPTPVTALGVVPPAQPAKSKKGVKRKADTTTPATAYDYLPSGADSNSSSSASKISKRRESGRQIKKPLRSQELDGLGPYSGGPAGIPSPGSQAALALKSKEKLNDTLKACNEILKELFSKKHCSYAWPFYKPVDADLLGLHDYHDIIKKPMDLGTVKRKMDSREYRSAQEFAEDVRLIFTNCYKYNPSDHDVVAMARKLQDVFEVKFAKIPDEPLNRISGMVPNESSSSGSSSESSSETEDSEEERRNKQLKQLEKELTAMQERMRKLVEESTKRKKEKKKQKMKDKPKKNSVQALALPNSTGPRGPKPGAGAPGVNAGGPAGKRAKAGRGAGAGGAGPGRKKAQPVSVVPAFDSEDEDSAKPMSYDEKRQLSLDINKLPGDKLGRVVHIIQSREPSLRDSNPDEIEIDFETLKPSTLRELESYVASCLRKKPRKPYYKKLPGKSKEEQIAEKKKELEDRLLDVNHKIGPTKKAPKKDAKSDPTGAGAGHMSSSSSSSDSDSSTSSMSSSSSDSSDSEAGASAARQAKKPKIANPKKSPNPSVNHNNGGAPLTVPPTIIQVPQLQQKQSPQPPVVATPIPTTATPTVNSVVPTPPITPVNGPSPPIKPVAAPRKPSTSDKPPTIPSPVPAQPPNTGGGVTKMGVGVAASPDKPKVPSPLLTTAVQQQYTDPIEESLANLEQEMKIEPIDNVIAMTTSIAQPKQQQMPAINAMVPQHHLSMPPNPLASLELKQPLGLPPTIGGMPPNPLAVPQHHNLHMDQDMQSLMHQGHSHPGIHTQNNGYSIKHEFDSSMGTNNNGMATLGLPMEMSIPSMFDPLPQHVNNMQMLKKEMPLMKNEPQDVYDKKAQMHEQHKSMGAFPGYNKAKPDVKNASSWSSLAKASSPPNSNSGNSSKQQNMMQVMDSFKAFQNKAKEKADREKQRLETLELKRQQKEQAERERMRQEIERRREVEEQEALEKARQAVAEREKPVQAQRVEELRSSPGEGSTSPGSLSSGSDRISDRERQRLQEQERRRREVMANKIDMNMQSDLMAAFEGSLQCLSRD

SEQ ID NO: 12188 - protein, 380 aa, Ceutorhynchus assimilis
MSLSTTRPLVSVYNEKSEEVKGSSIALPIVFKAPIRPDVVNFVHQQVSMNRRQPYSVSDTAGHQTSAESWGTGRAVARIPRVRGGGTHRSGQGAFGNMCRGGRMFAPTKPWRRWQRRVNINQRRYALASAIAASGVPALVMSKGHVVDQIPELPLVVSDKVQELTKTKQAVQFLRRIKAWPDIQKVYKSQRFRAGKGKMRNRRRIQRKGPLVVYHQDQGLRRAFRNIPGIDLISVEKLNLLKLAPGGHVGRFIIWTESAFGKLDKVFGSSSAQKGNLPQTKMANTDLSRLLKSDEIKAVLRKPQKKIVRRVRRLNPLTNTKALVRLNPFAAVLKREAILSQQKRAKLAAAPAVKKAPVAKKAPVAKKAPAAKKAPAAKKA

SEQ ID NO: 12189 - protein, 1771 aa, Ceutorhynchus assimilis
MADFIDSEAEVSSEEEELEPHERKKLKKVKAMDDSSEEEEDDDDRLREDLKDLIDDNPIDESDGEDSDASGRQKRKKSDDEEDLDDRLEDEDYDLLEENLGVKVERRKFKRLRRIQDEESEGEDENDAEQDREQIANDLFSEDERDGGSRKDDERHSERSHRPTVVDPDQFAEEEDEGEYSDADDFIVDDDGKPIARKKKKPIFTDAALQEAQETFGVDFDYDEFSKYDEYDDEEEDEEDEYEEDEEGERRRRQKKAAKKRPTKKSIFEIYEPSELKRGFFTDLDNEIRSTDIPERMQLRDVPLTTVPDDSTELDDEAEWIYKQAFCKSTVSNMDVNLTQEAREKQRKGPLAIGKIRKALEFMRNQHLEVPFIAFYRKEYVQPELNINDLWKVYKFDAKWCQLKTRKENLLNLFEKMRSYQMDQVMKDPDAPLPDNLRIIKDNDIERLKNVQTVEELNDVHNHFILYYANDLPAMHAAWRLKEKERKKQLRREARLKAIAEAEDGADIPEEIPDEDQDDEPEPETIKYANRSGSYSLCSRAGLESLAKRFGLSPEHFAENLRDNYQRHDVDQEAGEPNEVARQYVCPKFQTVEEVMQAAKYMVALQIAREPLVRKCVREVFYERAKITVNPTKKGQKVIDEAHNCFSMKYLKNKPVRDLAGDQFLKLTLAEEDQLVTIQISSTIEGHTSSSFIDEVKQLYIRDEFSKNVQEWNKVRSECVERALTRCVIPDLQAELRRVLLAEAKEFVLKACCRKLYNWIKIAPYQVEFPEEDEDEWDTSKGIRVMGLAYVPDYSQSAFTCISTADGDITDYLRLPHILKRKNSWKQEEKLMKEADLTALRNFIYTKKPHVIAIGGESREALMIAEDLRGIVKDLIESDQFPAIKVEIVDNELAKVYAISNKGIADFRDYPELLRQAISLARLMQDPLIEYSQMCNSDEEILSLRFHKLQDQLTKEELLEALCLEFVNRTNEVGVDVNLAVQQAHKSHLIQFICGLGPRKGQALLRILKQTNQRLENRTQLVTACHMGPKVFINCSGFIKIDTNSLGDSTEAYVEILDGSRVHPETYEWARKMAVDALEYDDDEGANPAGALEEILETPERLKDLDLDAFAEELERQGFGNKSITLYDIRAELNSRYKDLRSPFRSANPEELFDMLTKETPETFYIGKLVQVSVVGIARRKPQGEQLDSANPVRNDETGLWQCPFCLKNDFPELSDVWNHFDAGSCPGQATGVKLRLDNGISGYIYIKNLSDKPVNNPEERVGIGQLIHCRIIKIDVERFSVDCTSKSSDLVDKNHEWRPPKDPFYNQEQEDKDLRIEAEKRQEKQKQTYIKRVIVHPAFHNISYKEAEKCMVNMDQGEVIIRPSSKGADHLTITWKVGDGIYQHIDVKEEGKINAFSLGKSLWIGNEEFEDLDEILARYVTPMASNARDLLYFRYYKDTNGGMKDKAEEAIREEKKKNPNKIHYVVSAAKNFPGKFLLSYMPRNKIRHEYITVTHEGFRLRQQMFDSVGSLFKWFKEHFRDPIPGGTPSTPRLGSTSSRTPFQGGGTPYNNVNSEAIQRVAQNLPSHMLQSLSAVANQTPHYPHTPGGAYGANYVTTPYTPSSQTPFMTPYATPHTQTPSFSPSQQSQSGLPQGQSTFLHPGSVTPSNHSVSSSYSRASQRSHMSSRNPPNNSAGYHHRSGSAYGSTADQMDWQKAAEAWAAKSKGTPRSEGRITSRGSTGQRTPRYDDIHADLERTRMKNVGKSPRSMRSTTPLSMSMGDATPLYDENI

SEQ ID NO: 12190 - protein, 856 aa, Ceutorhynchus assimilis
MASDKETDPRVLVQEDTEGKASKEKGNDNKKKSQDKRRHSRSRSKSPDREQRREKRRKRKGSDEYQIMPRYYGDDKKKENSDKYWSKYPKKDEHRVGKRYYEDDPNNSDDENMENKRAGKKASKDDKKVEDKSVIKPRERKTVDLLTSRTGGAYIPPAKLRMMQAEITDKSSAAFQRIAWEALKKSIHGFINKINTSNIGIIARELLHENIIRGRGLLCKSIIQAQAASPTFTNVYAALVAVINSKFPNIGELLLKRLVLQFKRGFKQNNKTICISASTFIAHLVNQSVAHEILALEILTLLIETPTDDSVEVSIAFLKECGQKLSEVTSRGINAIFEMLRNILHEGKLEKRIQYMIEVMFQIRKDGFKDHAAVIEELDIVEEDDQFTHLIKLDDVVQADTDDILNVFKFDDDYQINEGKYKILSKEILQSDGESGSGESGSEEDSDEDSDEDDEEEEVKKDQGTIIDNTETNLIALRRTIYLTIQSSLDFEECAHKLLKMELKPGQEIELCHMFLDCCAEQRTYEKFYGLLAQRFCQINKTYVEPFQQIFKDTYSTTHRLDANRLRNVSKFFAHLLFTDAISWECLEAMKMNEEDTNSSSRIFIKILFQELAEYMGLGKLNQRLKDPTLQGHFAELFPRDNPKNTRFSINFFTSIGLGGLTDELREHLKNLPKNMPTVTKEESSSSSSSSSSEDSSSSDSSDEESEDEKTKKKDKQKISKSSQERPRDKTQRTSRDETNKRSSREDEENYRKQSRRREQRNNSEERENRERSRYNDQNKDRRRDYEWVKSRYEDNISQLKDRRRAFERPRGKDDRVKEEKNRRSRSRDRIRVKDEDDRSKDREYRHRRNHERQRS

SEQ ID NO: 12191 - protein, 594 aa, Ceutorhynchus assimilis
MALKNQVGQKIMNEVIKYKPQKKNGPAAVAGGKMEWRVLVVDKLAMRMISACCKMHNISAEGITLVEDIFKTREPLPTMEAVYLITPSKESVEALMRDFDGIKHIMYKGAHVFFTEACPDQLINDLARHPVAKYIKTLKEINIAFVPNEAQIFSLDCAETFQCYYNPAYSQKYSANMERMAEQIATLCATLGEYPSVRYRSDWDKNVELAQLIQQKLDAYKADEPTMGEGPEKARSQLLILDRGFDCVSPLLHELTFQAMAYDLLNIQNDVYEYEASAGVKKEVLLDENDEMWVELRHQHIAVVSQSVTKNLKKFTDSKRMTASDKQSMKDLSTMIKKMPQYQKELSKYATHLQLAEDCMKQYQGYVDKLCKVEQDLAMGTDAEGEKIKDHMRNIVPILLDPKITEQYDKMRIIALYAMTKNGITEENLQKLATHAQISNKQTIANIQYLGVNVVNDGSTRKKPYTVPRKERITEQTYQMSRWTPVVKDIMEDCIEDKLDQKHFPYLAGRAQSTGYHPTSASARYGHWHKDRSQPTVKNVPRLIVFIVGGVCFSEIRCAYEVTNALKNWEVIVGSSHILTPRAFLEQLTSLTPN

SEQ ID NO: 12192 - protein, 713 aa, Ceutorhynchus assimilis
MMQQYMKELEQEPFDAEEFVERLAWRTINETKTEGDEGDLNPTFLHDSFVQAIKDLTLLQERQQKKCERLEGAVREDEAMFFQEIYTLLEQNKQSMDTFQELDSKINHVATKVLHLGDQLDSVNGPRARVVDAQKLMTHLSEFLSNGPLTSSIFNDPYRIDEAADVIQKLFLISQDLPSPKFENVKRKIERTYSDIEKALIEDFVRAMSKEDLVRMRAIANVLSQFKGYSQCVDAYIDQSQAGCLLSKDVFAHLVPLCKHNYEIIKEVFNSPEQVMAKFVLNLYQLKLADYIDSRLSAKVGSYGYLQILYELYSKTNQFSNELSVYDLGNDQNYLSKLTTKIFNKYISDYVQIELKCLKERCAANLQKYYEAKNHQKKQIQTGGFQELRRDLQAVIGTRANINIAQIENYGGETFLSEELAITILQDTKNAFLRCQLLSKPEEKATNASKILNTLVNSLLIEHVDYAVELGLQAVPVVEGAKTSPTLSFFTIVHQCNNITHLLEKQFTDMVVPLIINTQFYSESLQKKKYVLEDIERKVNVGLDRCLNAVAAWVKLYLQTEQKKGDFKPETDDFDTVSSPACKAVCQHISNIIKQIKSSLDGNNVMAVLEELGVRLHRTIYDHMLQFQYNTAGAMVAICDLNEYRSCTKSMGPLVTELFETLHALCNLLLVKPENLHQVCSEDSLVNLEKSILHNFIQLRSDFKTQKPTIFKT

SEQ ID NO: 12193 - protein, 271 aa, Ceutorhynchus assimilis
MDFQNRAGGKTGGGGVASWSESNRDRRERLRQLALETIDLQKDPYFMKNHLGSYECKLCLTLHNNEGSYLAHTQGKKHQANLARRAAKEAKDAPSMLQPEKPRVEPKKFVKIGRPGYRVTKQRDPETGQQSLLFQIDYPEIADHVLPRHRFMSAYEQKIEPPDRKWQYLLFAAEPYETIAFKVPSREVEKTDQKFWTHWNRDTKQFFLQFAFKIENKKLTNIVPRPPMMGVGIPPPPPMLPVPPPPRPPMFNHPMPPPPMMRGVMPVPPPR

SEQ ID NO: 12194 - protein, 134 aa, Ceutorhynchus assimilis
MSIGVPIKVLHEAEGHIVTCETITGEVYRGKLIEAEDNMNCQMTQITVTYRDGRVAQLENVYIRGSKMRFLILPDMLKNAPMFKKQTKAGVAGRGKSGILRAQVARGRGRGGPPQRGRGNAPWQQQVSAGGRGR

SEQ ID NO: 12195 - protein, 440 aa, Ceutorhynchus assimilis
MASNIAKSTIFRAVGTRGYAQLAPVSGSTNYQVNVKTLPNKLVVVSADNDSPLARVSIVFRAGARNETSENLGAAHVIRTAAGLSTQNMTQFAITRNIQQLGASLTATSDRETISYTLEGTRQAVEKALPYLTEVATQQVFKPWELAELSDRLRIDLATRPLQLRAVDLLHKAAFRTGLGNSLYAPKFQIGKISSETLQHYVSSNFTSARGAVVGLGLDECKMDELAQSLTLDDSNGHVNVSPYKGGEIRSDKGGSFAFMAVAGEGASVKNPKEAMATAVLQRALGVGPQIKWSTVDNGILSKAICSSEGYASSAISATYSDTGLVGVLIAAPAKAAGKILEGAVKALKSGNVTDADVARGKNQLKTALLLHLESGSEAVELLGKQAVLAGGAMSPCELAAAVDSVSTADVRAALSKAGRKLTIASVGNLSNVPYADDLK

SEQ ID NO: 12196 - protein, 110 aa, Ceutorhynchus assimilis
MRRSHAGNYYEPLPQDNNEIEHENERMAQELSDKIGVLKSLSIDIGNEVQFQHKLLRDVDDDMDRTGGFLGKTMSRVVKLSRGSHNYIIIYLFVFAIIVFFILYLVLKFR

SEQ ID NO: 12197 - protein, 492 aa, Ceutorhynchus assimilis
MSISTKQAAREHVLAVSRDFVSQPRLTYKTVSGVNGPLVILEDVKFPKFNEIVELKLADGSLRSGQVLEVSGSKAVVQVFEGTSGIDAKNTLCEFTGDILRTPVSEDMLGRVFNGSGKPIDKGPPILAEDYLDIQGQPINPWSRIYPEEMIQTGISAIDVMNSIARGQKIPIFSAAGLPHNEIAAQICRQAGLVKVPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPVNVLPSLSRLMKSAIGEGMTRKDHSDVSNQLYACYAIGKDVQAMKAVVGEEALTPDDLLYLEFLTKFEKNFISQGNYENRTVFESLDIGWQLLRIFPKEMLKRIPAATLAEFYPRDSRH

SEQ ID NO: 12198 - protein, 129 aa, Ceutorhynchus assimilis
KYLKAERPKQELDLDQKLADKETQTIPCGKPKVPEGYQDLLLEFTINCNLHHPRNLVDYAAEYFAALKDQKHTKIVYDLVCTEKEEKTDRDSTAFSEATTVTDSEFSKDEHEKIILTSAESDSVPILLN

SEQ ID NO: 12199 - protein, 798 aa, Ceutorhynchus assimilis
MSYQSRAMPYQGTGDMPMANSKEQNVMSWQQNNYMGDSGIHSGAQTQVPSLSGKEEEDMDLFDLDQGYQGFTQDQVDDMNNQLNTTRSHRVRAAMFPETLEEGIEIPSTQFDPGHQTAVQRLAEPSQMLKHAVVNLINYQDDAELATRAIPELIKLLNDEDQVVVSQAAMMVHQLSKKEASRHAIMNSPQMVAALVRAISNSNDLETTKGAVGTLHKLSHHRQGLLAIFKSGGIPALVKLLSSPVESVLFYAITTLHNLLLHQDGSKMAVRLAGGLQKMVALLQRNNTKFLAIVTDCLQILAYGNQESKLIILASQGPVELVRIMRSYNYEKLLWTTSRVLKVLSVCSSNKPAIVEAGGMQALAMHLGNSSQRLVQNCLWTLRNLSDAATKVNGLDSLLSSLVQVLASSDVNVVTCAAGILSNLTCNNQFNKETVCQYDGISALVRTIMNAGDREEITEPAVCALRHLTSRHEKSELAQNQVRSVPSDQNDRLVGGIPVIVRLLNPPSRWPLVKAVIGLIRNLALCQDNFAPLRESCAINYLVQLLMRAYQDTQRRASLASGGSQQPGTYADGVRMEEIIEGTVGALHVLAREFYNREQIRQQGVIPVFVQLLFNDIENIQRVAAGVLCELAADKEGADLIEQEGATAPLTELLHSRNEGVATYAAAVLFRMSEDKPQDYKKRLSMELSSSLFREENLWNPDLGMGTDFQDILSPEQAYDNMYAQGPPSVHSSHTGRPYQQQGYDQIPLNMQAMDIGSPLDAMDVTGAEPDLNFDGIDQLPTPPQDNNQVAAWYDTDL

SEQ ID NO: 12200 - protein, 278 aa, Ceutorhynchus assimilis
MARNAEKAMTTLARWRAAQAGEIDKSKRRRPYLASDCKSLYACEKWRMHIIREIAKKVAQIQNAGLGEFRIRDLNDEINKLLREKRHWEDQLKELGGPDYQKIGPRMLDHEGKEVPGNRGYKYFGAAKELPGVRELFEQEPPPPPRKTRAELMKDIDADYYGYMDDDDGILIPLEMQAEKIAVQKAVTEWKAKKEARKAAGEASDEEDQEVSVYAVDEDVEKDEILEDPSQQLLDGSQQRFVAHVPVPSQQEIEQALLRRRKQELMEKYGVLDKTINK

SEQ ID NO: 12201 - protein, 215 aa, Ceutorhynchus assimilis
MAAEQQLPTFKCVLVGDGGTGKTTFVKRHLTGEFEKKYVATLGVEVHPLVFHTNRGEIRFNVWDTAGQEKFGGLRDGYYIQGQCAIIMFDVTSRVTYKNVPNWHRDLVRVCENVPIVLCGNKVDIKDRKVKAKSIVFHRKKNLQYYDISAKSNYNFEKPFLWLARKLIGDPNLEFVAMPALVPPEVHMDPQWQQQIEKDLVEAQNTALPDDDEDL

SEQ ID NO: 12202 - protein, 851 aa, Ceutorhynchus assimilis
MPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEDGDDGDDPRKLKPGEIDPNPETKPARPDPKDMDEDELEMLSEARARLANTQGKKAKRKAREKQLEEARRLAALQKRRELRAAGIEVAPRRRKKRGVDYNAEIPFEKRPAIGFYDTLNEELDPMAPDFSEMTQQKLDGNLRAEQEDRERKKDKQKLKQRKENDIPEAMLQNQEPARKRSKLVLPEPQISDQELHQVVKLGKASEIAREVASESGVDSTDTLLNDYTVTPHATATPRTPAAQTDRILQEAQNVMALTHVDTPLKGGLNTPLHNSDFSGVVPQQQAIATPNTVLATPYRSVRSETGSTPGNTGFMTPKSGAMVPVGGTSTTYVAPSIRDKLNINTEDALEVGDTPAQHLMYQMSTKQQLKMGLSSLPTPKNDYEIVVPDNEEQTIPEQAQEKSIEDQADVDMRYQEEMKAKAAKELLLRSQVIQRDLPRPQDVNLSVLRPANESYSLTELQKAEELIKLEMSTMLQFDNLKNPVATQSKPSNKSQAQQLAFLEEHPYRNFQAEELETAKQMLKKEMEVVKKGMNHGDLPMDAYTQVWEECLGQVLFLPNQNRYTRANLASKKDRLESAEKRLEQNRAHMAKEAKKAARMEKKLKILTGGYQSKAQSLIKQLTDAYENIDQANLELKTFKFLQEQERNALPRRIQGLTEDVSRQLEREKGLQTKYNDYQNKIIDLQEQLGYEQQETAEQVEDLDGVSVQPETEQVTNNLNATVEENISSTINGLDKEEENVAVQ

SEQ ID NO: 12203 - protein, 156 aa, Ceutorhynchus assimilis
MQFMLLFSRQGKLRLQKWYVAHPDKLKKKITRELITTILARKPKMCSFLEWRDLKIVYKRYASLYFCCAIEQDDNELLTLEVIHRYVELLDKYFGSVCELDIIFNFEKAYFILDELMLGGEIQETSKKNVLKAIAAQDLLQEEETPQGFFDDHGLG

SEQ ID NO: 12204 - protein, 419 aa, Ceutorhynchus assimilis
MHQISKFLFYQAARTSKNGVRYYSREPQKRPTFLSRLYDNFREEMSKNKEMKESLKKFKEEAEKLEQSDALKAARQKFETVEKEATKSSDVFKERFSTIKDKVSSVIDEAGKTELVKKAGKISEEISKTTHSIGEKAQEIGKTNAFQSISKATEAVKKEMDTNSMQGRVYVSPIKLRKRTETSAVQNQKHYEPNTEAMGIELHKDSKFYQSWQNFKDNNPYVHKVMDWKLKFDESENPVIRASRVLTEKVSDIMGGLFQKTELSETLTEICKIDNSFDTKRFLKQCEADIIPNVLEAMTRGDLEVLKDWCHEGPYNLFSIPIKEAYTKGYKIESKILDIDNVDLVMGKVMEQGPVLIISFTSQQVMAVRDSQGNVVEGDPDKIMRVTYVWVLCRDISETDPRAAWRLLDLSASSNEQLV

SEQ ID NO: 12205 - protein, 302 aa, Ceutorhynchus assimilis
MDYSSDSELSDSDRELQEAFVEGKLKPGLNTVHQAPKKAVNNVEGLNHKLEEIYLNLPWIERLDCINAQAPLAPELAAQLMAHEQKRENQLKNNKKLPQLKASEDPILNDFKREMEFHRQAQAAVLDAIPKLKALGIPTKRPDDYFAEMAKTDEHMQKIREHLMTKQQQQQRSERVKQLRQQRKEGKMLQIQTKLQRQQEKKEMLDQVKKHRKGVSKDLDFLDSKKSKAISRKALEKRNMKNKKFGFGGKKKGGKLNTRDTAADISEYRSPKPGGRKGRDSKGKQKNNRPGKNRRIKAKNKK

SEQ ID NO: 12206 - protein, 622 aa, Ceutorhynchus assimilis
MNQGAPNYPMASLYVGDLHADITEAVLFEKFSTTGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDETGSSKGYGFVHFETEEAANKSIEKVNGMLLNGKKVYVGRFIPRKEREKELGEKAKLFTNVYVKNFGEELSEEQLRNMFEKYGKITSYKIMNKDDGKSKGFGFVAFECSEAAEAAVEALNGKESVDGKPLYVGRAQKKAERQQELKRRFEALKMERLNRYQGVNLYVKNLDDTIDDERLRKEFTPFGTITSAKVMMEEGRSKGFGFVCFSSPEEATKAVTEMNGRIVGSKPLYVALAQRKEDRKAHLTSQYMQRMANMRMHQMGQFIQPGASSGYFMPTIPAPQRFYAGAQMPPIRTSPRWPSQSQVRPTGQGVPAAYPGMTNPFRATTRPPNQTMSMRGNINVSRSITCPQPTNMQGRPLPGQSVVASNRTTFKYTANMRNPPQSMVPLPSQPVQQAVHIQGQEPLTATMLAAALPPEQKQMLGERLFPLIQRMYADLAGKITGMLLEIDNTELLHMLEHNESLKNKVEEAVAVLQAHQAKQSVIKKD

SEQ ID NO: 12207 - protein, 920 aa, Ceutorhynchus assimilis
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSGLVEDQGFLEQLKELLSDSNPMVVANAVAALSEINESSPTGQPLVELSTSTINKLLTALNECTEWGQVFILDSLSNYTPRDDREAQSICERITPRLAHANAAVVLSAVKVLIKMMEILQGDVEFCNTLSKKLAPPLVTLLSSEPEVQYVALRNINLIVQKKPDILKHEMKVFFVKYNDPIYVKLEKLDIMIRLASQANIAQVLSELKEYATEVDVDFVRKAVRAIGRCAIKVEPSAERCVSTLLDLIQTKVNYVVQEAIVVIKDIFRKYPNKYESIISTLCENLDTLDEPEARASMVWIIGEYAERIDNADELLDSFLEGFADENAQVQLQLLTAVVKLFLKRPQHTQGLVQHVLSLATQDSDNPDLRDRGFIYWRLLSTDPAAAKEVVLADKPLISEETDLLEPTLLDELICHISSLASVYHKPPTAFVEGRSAGIRKTLPARQGSEEAPTQEATVIPNQESLIGDLLSMDLGGPTIPTPAAAPVVAPTSNVDLLGGGLDVLLGGGPEVTSNVGAAPSTTGLLGDIFGITTTPTMYTPPKALWLPADKGKGLEIQGTFSRRSGQIYMEMTLTNKAMQAMTGFAIQFNKNSFGLAPSVPMNVTALQPGQSLEYSLPLSTTGPVQRMEPLSTLQVAIKNNVDVFYYACQIPLQVIFLEDGTLDKRVFLTTWRDIPSANEIQYTLNDINGGTTDSISNKMTRNNIFTIAKRNVEGQDMLYQSLKLTNNIWVLLELKLTPGLSYATLSLKSRSLEVAPFVFQAYEMICKN

SEQ ID NO: 12208 - protein, 165 aa, Ceutorhynchus assimilis
MPPKFDPNEVKYVYLRCVGGEVGATSSLAPKIGPLGLSPKKVGDDIAKGTADWKGLKITVQLKIQNRQATISVCPSAASLIIKALKEPPRDRKKQKNIKHSGNISFDDVISIARQMRPRSMAKNLAGTVKEVLGTAQSVGCTIDGKAPHDVIDEVNAGSVEVAEE

SEQ ID NO: 12209 - protein, 365 aa, Ceutorhynchus assimilis
MSDQSGMRALILVGGYGTRLRPLTLSRPKPLVEFANKPILLHQVEALVKVGVTEVILAVSYRAEQMEQELADEAKKLGVKMVFSHETEPLGTAGPIALAGEHLRKSDKPFFVLNSDIICDFPFKKLIEFHKSHGKEGTIVVTKVEEPSKYGVVVYNEQKCIESFVEKPQEFISNKINAGLYVLNPSVIDRIELKPTSIEKEVFPNMATDNQLFAFELEGFWMDVGQPKDFLIGMCLYLKHLRSADPEKLYRGPGVIGNVLVDPTAKIGKSCQIGPNVTIGPGVVIEDGVCIKRTTILRDATIRSNTWLESCIIGWRCTVGQWVRMEGITVLGEDVIVKDETYINGGQVLPHKNIGDSVRTPQIIM

SEQ ID NO: 12210 - protein, 288 aa, Ceutorhynchus assimilis
MASEGDEIISDQEKVRIVSDFIIHSPPGEFNEVFNDVRKLLDNDDLLKEGASGAFAQYNKDQLTPVRIENSDHWVLITEYNDLGNNRFFDPRSKQSFRYDHLRKEASDYQSYSPDTTAEPWRSALDTEFVQYTRNHYKDGVCSVIGRSQGGVVSLTACIEDHQFQPKNFWNGRWRSQWFITLNGTSGAELRGVLKVQVHYYEEGNVQLVSTKETKDTVSITTEAQTVKDIVQAIEAAENLYQTAISENYHTMSDTTFKALRRLLPVTRTKIDWNKIVSYSIGKELKTQ

SEQ ID NO: 12211 - protein, 1274 aa, Ceutorhynchus assimilis
MKLRIILLVTVFCGVSLGQDLNESNPDVEAVPGIILDLGESSGQPVPAEDVPQTPTQPTNNDTDNVAVDDVEQMPGNTSLRTGQKILRFGKYVTYYEADYDPMTSHVAPPDTDQRGGSGTPYTLTETRLQTIRKLFMYPFYDQGGNADNEGDYQKEIQSSSPQVHKNFNFQLPFFGFRFNYTRVSLNGYLEFSDPPPNYNYPLTFPVRDWPKKNDPSFIGIFFSKCRIGNLRDEDEDKRLPGVYFRMERDLLTRTDQMGVEIRERLKWDIREGVIGSEAFDPKHAVIVTWKNVSFNGGFGNAIYKTNTFQMVLATDEVYTYAIFNYLNLDWTSHTEAGGDTTRGEGGVPAYIGFNAGNGTRSWEYSPYSQASVLRDLSGRGYANGFPGRHLFRIDENILVGTCNKDIDGANLPLMFAPESGNMLGGTVVNITGPCFNPTDQILCKFDVANVVYGTVVSRNRAICVQPLLMVEGYVRFEIAIGPGTYKWKGRYYVETPASAAQKIYFKDMKVHEKSPSEIKITWEKYNLTTNENANIRISLWGYRETSIRPSLLYITDIAENVQNTGEYTIVPSQYRNRENTFLTDIKFGFIQINLTESIPIQYDYSGTTQTTTQATTINPVVWSRPIPLGWYFGWQWERMYGTNWPKTLCDDWLRTDRYLKNFAHELPQCPCTLEQALIDKGKYMPDFDCDKDSNPTCYYNNQAVHCVRTGSPTLEGSEQQCCYDKNHYLMLSYDQQWGSSPKRCHNLGLMPYQEATKVPTLSQWFNDMVPKYLCCLWQDEQAVGCETVRFERRPSQDCVAYQAPGVAGVYGDPHIVTFDDLEYTFNGKGEFVLVKSKAKLNNIEVQGRFEQMDPNLYGEVRATQLSSVVARGNSSTIVEVRRRPEYARWRYRLDVIADGKRVYFDRPSLKFQHFPGVTVYTPTYILNQSEVIMMFDNGVGVEVLDNQGYMTARVYLPWTFINKTAGLLGNWSFNKEDDFTLPDGSKVSVATNVNDMERVYTTFGSLWMVDDVLDSNKGRAMFLRENGQSSANFNNKSFVPIFAMTPEEIIPANRSSQIDRTYQICTSKMYECYYDYAMTLNRDLAHYTQNYKATIYQYKELSRTKVISCGVLPTPRFGRKSTFLFIPGTKVTFECDQDFVLVGDARRTCQANGQWDVPEYGYTYCLRQQEYSQRQLAMASGVVFLIIIPLLLLFFYLAYMYLRKKQQEKEEEEMLDSAYEAQKRRAQEAAAKKLTEANEYDDDDDVTSNLTSTASPVPHTAPASPTAKESTIY

SEQ ID NO: 12212 - protein, 111 aa, Ceutorhynchus assimilis
MRYVAAYLLSVLGGKASPSAADIEKILGSVGIEAEAEKLKKVISELNGKSIEEVISQGREKLSSMPTGGAAAPAAAAGAAPAAEEKKESKKEEKKEESESEDDDMGFALFD

SEQ ID NO: 12213 - protein, 920 aa, Ceutorhynchus assimilis
MTTMTALPLGTIGDHFGLKWDPKNLEIRTMSVEKTLEPLVLQVTTLVNTNGPSKKKKGKSKRANALVQTVEKATENFIEKGEQIAYENPDITEEMLAAVDEVRKTGTQMSRDARDFSEDPCSSLKRSNMVRAARNLLSAVTRLLILADMVDVHLLLKSLHIVENDLEKLKMASSNDELLDNIETFRHNANELMNQAAKRQQELKDPQLRDDLAAARAVLKKHSTMLLTASKVYVRHPELAAAKANRDYVLKQVCEAVNTINDVAQGRAPPAAGPYDGPGELAAALDDFDEHIVIEPLAYNEVHTRPSLEERLESIISGAALMADSSCTRDDRRERIVAECNAVRQALQDLLSEYMSNMGNKDKTESLGKAIDNMKGKTKDLRRQLRKAVVDHISDSFMETGIPLLILIKAAQNGDEKQVEDYAGVFTEHSNKLVEVANLVCSMSSHEDGVKMVRYAAAQIDSLCPEVINAARILAARPRSKVAQENMDAFRLTWENQVRILTDAIDDITTVDDFLAVSENHILEDVNKCVLALQENEADTLERTAAAIRGRTGRIGVVVAAEMDNYEPCIYTKRVLEAVKVLNDQVMPKFTQRVQVAVQAIINGQQGQPSKELDENEFIDASRLVYDGVREIRRAVLMNRADEDLDPEDVELDENYTLETKSKSSAHTGEHGVDEYPDISGITTAREAMGKMPEEDRKKILQQVEYFRSEKLKFDREVAKWDDTGNDIIVLAKHMCVIMMEMTDFTRGRGPLKTTMDVINAAKKISEAGTKLDKLTRQIAEQCPESSTKKDLIAYLQRIALYCHQMNITSKVKADVQNISGELIVSGLDSATSLIQAAKNLMNAVVLTVKASYVASTKYPRQGTVASPIVVWKMKAPEKKPLVRPEKPEEVRAKVRKGSQKKLQNPIHALSEFQSPTESV

SEQ ID NO: 12214 - protein, 421 aa, Ceutorhynchus assimilis
MSFNFGTPPNTMAPPNATAPPKAATGFTLPSSTPVSAASGAPGGGFAFNLSQTPGAGDNKQTPSLFSQFKPATPATPTGLNFNLGQAPKTAAPTLSFGTPTAPATTGATAGFGGFGLGTAGKRPAPASVTSTAATSVPGLQFSFSSPASAAATTATTTFTPIVGSTATSTINVPATAPTSSAPKLGLGVAPTTTTPATTGFSLGLGSTAATTTTVTSAQSTTSTAATTTTGSLTFAQLEDAINKWTIDLEEQGKFFINQAKQLNAWDTLLISNGDKILNLNTNIVKVQQQQSQLDQELDFISAQQKELEELLVPLETELMDVPATDINRNQMYQFSEIIDSQLKQISDDLKEIVEIINGSNKDQDTSNPIQQVSKILNSHMHSLQWIEKNTSEISKQIEELSKMDENTRKNISFNGSNLYQ

SEQ ID NO: 12215 - protein, 193 aa, Ceutorhynchus assimilis
MFIWDWFTGVLGYLGLWKKSGKLLFLGLDNAGKTTLLHMLKDDRLAQHLPTLHPTSEELSIGNMRFTTFDLGGHTQARRVWKDYFPAVDSIVFLVDAYDRSRFKESKQELDSLLTDESLANCPVLILGNKIDLPGAASEDELRNYFALYQQTTGKGKVPRADLPGRPLELFMCSIKKRQGYGEGFRWLAQYID

SEQ ID NO: 12216 - protein, 185 aa, Ceutorhynchus assimilis
MDGIDLLEKRIEALEEQILPKETSLENKSQAITDLLLQSQTMITSALSCRESITSILGHMTTINNYLDPCNWENDLEVEAKRHYLLELYPELRNTVQLVRSVQKLIPYTNSDKIMKVTELSGKLEQLTETNLVVYSESRDVTQKVLKSLQQYNDITTSIKVLFAQLDRAVVVLEEALLPKFETEE

SEQ ID NO: 12217 - protein, 583 aa, Ceutorhynchus assimilis
MSTSEVYSDLTLYTTAEKLYLEPKTSDELLIIDRASEVISLQRNAGQIPPSNTRIDFCGLLGSIELLAGRYLVIITQRDLVGYIAGHPVWKLVKAELIPYSKSLLHLTNEKQADNNVYLSMVENVLATPSFYFSYSYDITHSIQRLHDISPEFWQQSLLERSDARFVWNKHLLQQFREPSLKRFALPLMHGFASINQCVINGHNFVWALISRRSVNRAGTRWFRRGIDKSGNVANFVETEQIVESGEGDRASFVQIRGSIPLFWFQKPDLRYKPSIDIDHSVDPQEHQNACLRHIESMAGVYGRQVMVDLVDQVGSEGRLEKAFKDTINYLAHPSVRYEPFDFHAECRKMKWHRLSILIDRVSLDQDEMGYFLILKDGTLSSLQEGVFRTNCIDCLDRTNVVQSMLAHRNLEIVLRKFDILSPDQKLEMQLSFESLNKNVWADHADLISTQYSGTGALKTDFTRTGKRTKAGLIQDGINSLMRYYKNNFNDGFRQDSIDLFLGNGKVVSPIAPPPGWRYITFPSVLLIATAMFVASAILPAEYSTECLMYLMFWGGMMAATAYYIFQYGPEFVDKPKLTNNNS

SEQ ID NO: 12218 - protein, 558 aa, Ceutorhynchus assimilis
MTIQNGAPAEKRQDRPSKPPEKKQELIVRVKYSNTLPDLPFDLKFISYPFEPSRFIQYNPTSLERNYRYDVLTEHDLGVNIDLINKDTYPTEPGVVLDPADEKLLEEDILAPQDSKRSRHHAKAVSWLRRTEYISTEQTRFQPQTMDKVEAKVGFSIKKSLNNETHYMDRNAQIEAIEKTYADSKIPIEKHYSKPNVVPVEVFPVYPDFNLWKYPCAQVIFDSDPAPVGKGVPAQIEEMSQAMIRGVMDESGEQFVAYFLPIEETLKKRREDFANGVAYQEDEEYEYKMAREYNWNVKSKASKGYEENYFFVIRPDGVYYNELETRVRLSKRRQKVGQAPSNTRLVVKHRVMNAGEFKIQRYREKQLEPPREDDEEEFEMDETQEDEVAANDSQGESDQEKDNVDIEDKPQDSDNESKGGRTSRQSRASSRTSRKSKSASRSKSGSRSSSKSRSRSVSRSKSKSPSRSRSASASKSRSPSKSPSRSRSASKSPSRSRSRSKSASRSRSRSKSASRSRSRSKSGRSRSRSKSGRSRSRSKSGSSRSGSGSGSGSASESE

SEQ ID NO: 12219 - protein, 389 aa, Ceutorhynchus assimilis
MPVENLEDQGLEKNPDLELANYKFLLTLPEFRNDKGVHAKITEAIKKDDMAPWYELVCQDAGWKKDEKLLKTFKTKNEEQIKKLDEAIEDAEKNLGEMEVREAYLRKAEYYSRIGDKENAISTFRQTYDKTVSLGHRLDIIFHLIRIGLFFMDHDLITRNIEKAKTLIEEGGDWDRRNRLKVYQGAYCMAVRDFKTAANLFLDTVSTFTSYELMDYKAFVRYTVYTSIISLPRNQLRDKVVKGSEILEVLHSEPFVKDYLFSLYNCQYADFFKNLAKVEEILRKDYFLNPHYRYYIREMKISAYTQLLESYRSLTLQYMAEAFGVTMQFIDEELSFFIATGRVHCKIDRVGGIVETNRPDLKNAQFNAVVKQGDFLLQRVQKLSRVINI

SEQ ID NO: 12220 - protein, 5234 aa, Ceutorhynchus assimilis
MDELPPVLDPDELMDLEEPETYEIEDDDEEIVEDPSSSPFQQFSSGPASNATSAASSPHTNDDFPPPFNFNGKPVTIKRGRGRPRREGGKPTPRRSGGVGVPRVRRAKSAGFSRCRGSRSVRQPDRMDFDFSYISPTSIDDMGLTDIDGFFFPERERPSPVFEELPYAPEVWPGKVCAFCNLGERSQLGQGEIMRLNCPDGFTPQRSVGESNTPAVQLPDRDFGDKSPRGPVTCRRNKNFNRSRSFVSNNEHIDELTIIGHAEEPSVNILYEISGQFYVHRNCALWSNGVTRTEHQALENVGPVVLKSSSQKCSFCNHFGASLTCRSTGCTKVYHFPCATASGAFQDITSLQVFCTNHLHEAALCSESAICYTCKSVGDISNLMYCSSCGTHYHGSCVGLAQLPGVRAGWQCRKCRNCQVCRMMGDETKLMSCEQCDKVYHASCQRPLVTSIPKYGWKCRCCRVCGDCGSRTPGAGLSSRWHLHYTVCDSCYQQRNKGCCCPICQRAYRSHAHREMVQCGTCRKFVHGTCDPEADLVTYQQKKEINPDYEYHCVICKNSLQQLSSRPVTSKRSSLDDFGDLSASQESLYDDISEFDMPSEESFRGTGLGKGKPYASKIAKKKLSYSTGMPGRPKGSFGKGNPGKQGFMKRQRLVEFGRKRGAKAKIRGVFGVPGVGLSRPVSDGKGDEEPGVENRLVLCSAKDKFVLTQDICVMCGALGTDQEGCLISCVQCGQCYHPNCVNVKVTKVILTKGWRCLDCTVCEGCGQRNDEPRLILCDDCDVSYHTYCMDPPLDYVPHGNWKCKWCACCRSCGSTDPGFNSTWMNGCTECGPCASHSACPSCNESYAEGDLIIQCAQCERWLHGICDLIKTEQDAEKCAEDGYTCLLCRPRDVPPPHLIPSSIAPKPPTPTKSPEVRSQPNIFVDGVCLSEWGHSLIKSLSQEYHGTRKKRKKLPPVVHDKEAGIMATIESVVAGGSGGENSFEDTKIELVDMKDEPQELYKEGMIWTKEDGSPPEGFTIFTMESGICVLRRKRQRNLQKLGIGGFLVRMRGFKSQENDEIDTLPGQSTLNFDLPIPMTSTLEGDKPKKKPIRRKQKSKLAETFPAYLQEAFFGKDLMDVTEFKKEMEGGVSSDEDKLFENKQQAIKLTAEELLAVESARQEKTTSEGRSQPRDGFSDTLKIDKPILIKEEEDDTAEDLKDVLALPGDLLDTDLVNSIINEDDELTKNTELDALADDDAELPQTLGSSENSKDAKDELSDILGSHFSLESIPNINSKDVEDIFKGVLTDESQESQLSQEATNMYPSMPSTPTPISPMFPSNSSQLPTAGIIPQMHLPSAPVRPTALPGVQHVSFPPSPYHSEYSNSPQFSPAFSEPPSPWVNINDNTEMDTASVAGVPSTHNQRSSEKMKADEGLGNGATISAVLYANRNHPEWKAEYPVWSDRYKHIIKKWRTLSQDEKAPYLQQARDNRSQLRMKKQQQSQTSKETSTTSPVAPTKPPPTVVPAAALVTNLPSPGLPPPSLVTQAQAQQSPTAITTEDQEKLAQQQRTAREAEQERQWKHLQAMRQQQAQQQAHVIQEQRVQAIARVQRTMSDPNPQFIPTNQTSPLQVTTTSQEGSPVAPPSPRQFIGIKSPPFAHPSPPSTNIRTPTSSQSPVHEFQQPNQQTPNPEESFIEPTSPQVNFSKVPTGNEAFGQPPPPRSPFVAARPPMQARPDQPEIARQLRELLQRQQQQQQLKNFDLVQAKSTQRIWNPNDPPATEPVNAGATAEEITFRQPLPPGSVRPRIPLQLGPRPGPNLRMPQLEGRLQGLDPRLRLILHQSRAALPGQQVPAGGIRFTQGANRPATIEQYEQLLHRQAQLQARNQALEQQGVGVRLPLGQSGGGVIQKQPSSITQAMPVVQPAQQAAATNDQEIPDNVTAELEKLEQETGTMAELQGVSEILGGLGDDDDELLAEMGADFNILEYADPELEALAGEKTNILDLDLEDDNMKQEKKREAMMQRQNNVSSAQTATSQATKTVVASNSQKEQKLEKRPTSTAAEEPHKSDASALPQPNNNPPLPLQKHQQVPQTHQVSQKHQVSQKHQVSQKHQPHSDNNLRPQTPALADQSQNQITQNLSQQRVVQNISSSQPQLAQALANNSNPQQQQQQQLPQPEPPVLQQQLQQQLQQQPPQLQQQQPSPSQHQPNIALTAQQLHQQMLQQVGCKMSKYVQQAAAMGKPMPPGSKLQTPEGIVGIVLANNNVQLQIPPNFQQRLLQTLQNQKLQMRIGRTVPRPQQPNINQPPQPVPGQIARPRMALPTPPPPPPYPGPPPPYPGNLMAQQQAMPQQEQPLLLEDLLEQEKREQEKQNHNHPLPSDINTRSNDSESALCVSDHDFERLKADVFSSGHSDTSSSDSTVGMVQQQWQPNRLQMPSAPTQHTTEVTTKIQMFNANLMPAPPLPSENIVTEQDKQAQLLYEQWLNNQNNVLTQQLRYYETEVLKLRKSKKSLNSKQRQLRKSGNQLTEIDSNELQRISAEQAILQKHLESSRKQSRQHGMLIQEYRNKQQLLQKPLMGGPQTQLASPLGPPGSSPIHHAAASHSPMLSPQQSPLPQQSPLTQHNSPMNSPGPMMVHSPGPGSVAALLQSPGGSVSPIQTRIGTPLSQEGSPGPIQSPSQVCLPPPMPRMTSPQHRRVVTSPVGYTGDMRSGVTQMRFMRPTVEHNSLQRIRGQAPGQLQNFPSKVGTPSPLNSPPLNQMSLAHQQILQKQLHQHQQALLHQQQQQQQQQQQQQQQQQQQQQQQHQQQQQHQQQLQQQQHQQLQQQQHQQIQISDGTQQQEANVMHSPRVAQLIQHRNLGRPQQQQQQQTLTAQQHQLLTKQHQQIALQLQARLNQQSQQQSPTPQSPMPPKSPMHNQNMSPLSMPTSPMPPKSPMLSFNQQQSTPNSPAAHRNSYSQNPTMNQPPSSPMMHQYHQPTSPMIQSPHAIRRPPSSPAMPERPLSVENPGTPRTPYSLDMHLQDNMHTGGGNPNNPNNPIPLPPDGFCYSKLGLRGGMWSGFGRGEKRVPTPPTSSSTSETEKQLPVEVTTLNKPKKEAHINKVSILKKRTPLPKSSPKSIITSKIADFTEYDETSSTSPASTSSLLAGRGGAGLKPLSKQDATGDKLQLPEMVDYEDDNSTILSSEISLCSAAQQNDDEIEITETLSQNDIGEVLSSPMEADQISDEFMLFQENMLVDHLSGIQYSDKEETEEEYANIVIRSPTTSDDEFIMQGRTKKYNILNIAETSGSPEQDTTMEPSTEPEDEEITQPFDESEVVIIEQPVKSPEEQISTKEDFEELIDEGSRKEKMKQDTKSVVEPPQFTAASVYRFPSKTPITVTRTQNVMTTAKVAPKISLITTAPIIQNFTARSEGGKLNAETQQLILTPTTKITTTNAGSKLTSIILTHNPVRSNILNVGQKLVTSSPGITIVSASTSQIASILPSKFSVPIISASAVRQLPNVKVIDKPSSSLSLTPRDSTLPNKIFEDESVSPENANFDDEKKNLFDEKLKAEFTAANGRMPMFGKNVIATNNKNDENNTSQRKNDKSEISNIVTKEKVQVIASPIIAKSVSPVIIHHAPPELKMTAQVIQETSTRMQITATETVSTFMGDGSVEDKSVVISIPSPTPSQEQMLDNIALQALEENRKREFDSFDYVLNMIENMQHSETPEQSDEQNTEKKSTKPAVKEEANESTANKQTMPQLSPLSQPADLTTNMANASQQLRSLLSNIQTTSSSHVPKVETLVKTANKQKIINVTSSTITSPVVASRIIQQATTTSNVSTVIVPNVVKQKVTLAPTSKARTSSTESFLTNRFLGSEPKSTTSTPSQTTETINKSPDLNKKASLTLTAMLQNQPSATPTTKSSPDTITAASLLATPVSLSRTSFSPALALAQPNAIIASSLANTSTSSVISSAFKTITSTNLLHTHLTKSRTKSLDDIKDLKTDDQKSEADIITSIKQELSGCRYLPVTSSSQINKCEDSQNVLLKQLLQNTACASTQSPPPSTTSTITTAPTTEVQKVSPPTLSSLLPPVTKTEVQPTSTPQSRPPMQRGLIRETSFVSSPIIQHTPTSTTVAATTTTQQLHIDIKKCAPVVRPSSRDDLLSPPTPRSCGSQESSLQTPPLIVKKESPASTSTCLSIEGIKKELLDESSQHSEISDLGKADIQIKEESEPGEISDKIIVDKEELKKQKRRMYNQKRRQNQLLNKELNNKPNKRPRKNSKIEEDYDSYIDSVLNQIRHLHPMVVSEPAIVRNHGILPVFGSGDLSKLGTKSFDPRFGDLTGTYGNASIPGYSDFYNTIPYGDEEPIPEKPPASTQRGFYDQEFPLIKFDTEDDKKFDLFSREDTPDSIVSCSSPECDAFDASDRYLGLKLISDDEEEEELSKGRRSPKIPIVKPIAIKLKAAGLFLKEPATTKIASDNNKENILKEMDQEKLKPNPSPSGPVKDNENIKVTLTFTSSAAEDIVGVLRDLANILQIPPPTSYQIVDRTSSPTSQKLGLYRTKGKDGKEGAPIDIQSILNGAAKFCKHCDVVILNNLVKKKPSDLPFLSKDSELLSEGEELYFCGSSCYMQFALMNRSPSIPEDKAAAIIDHLSQKDCQNLKQHGQLQDPFDSKSALVNRLLTENTGFNQYFGGAFKQTMKFGSFKPPEHAKSHRNASVKFWTPGCLQPSHKHKKPTDKEMTEMLYQMGITVTPSKLPDDTRKCMFCQVIGDGVADGPARLLNIDVDKWVHLNCALWSDGVYETVNGALMNLENAMQQSLTSTCIHCSKLGATIRCFKTRCSSVYHLSCAVRENCVFYKNKTVFCMAHVPKHEKDNELTTLSVGRRVYINRDENRQVAAVMHNSDTNNLLRVGSLIFLNIGQLLPHQLQNFHTPNYIYPIGYRIIRFYWSMRNVNKRCRYICSINDNMGRPEFRVLVQERSEEDTEFKDFTPKAVWAPILEKIASIRKENKCLQMFPRFISGEDLFGLTEPAIVRVLESLPGIETLSDYKFKYGRNPLLELPLAINPTGAARSEPRLRHQTHWKRFHRTTGSSSRPLFAPLPSNASAPSSFGESVCPYSKQFVHSKSSQYKKMKQEWRNNVYLARSKIQGLGLYAAKDIEKHTMVIEYIGEVIRSELSECREKQYEDRNRGIYMFRLDDDRVVDATLSGGLARYINHSCNPNCVAETVEIDRDLKIIIFAKRRIQRGEELAYDYKFDIEDDQNKISCMCGAPNCRKWMN

SEQ ID NO: 12221 - protein, 1390 aa, Ceutorhynchus assimilis
MDDDSEARKPKRQKTSYKAKAFEKFKQLKSGGRNKYEIEEVDNLYEVVDEREYAKKVLDRQDDDWIVDDDGSGYVEDGRDIFDDDLDAESINQAKSKNKGVKRKKAVSDNAPKGNLKYMLSNITSKKKEETQIEDDNMLSEILGEIDASPSTSKKDSKPFVPKSQLAQNYLKKFSIDKKTKAEKPPIDTVMDEEIVEIPLKNVDSEKDELLSNSKQATKIIPQKQKEEVSESHQNEDFHDAEDVFADDLDLVQMDAIESKITESETAAEPKNDSFDLAAMFTQSSGFNESLEEEEICTPSVSDDEAFRFFWWDAFEDAEKQKGKVFLFGKTYCRKSKSYLSCCVAVENLSSQVFVLPRPFMLDDSGKPTEKPVTYQELYKEFTSLVADKMNIQNYKARLCQKKYAFDPTVPAESDYMEVRFPANGPRIFPESIKGCPKTFSKIFGAFSSTLERFLLEAKLKGPCWLDIKNPIFNNHPMTWCKIEVKCASIRDVVKVAENLPPPPLTVATINFRHHINLGTNQQEILMVSCVTQTSYAVDKKAPRQVFDQHFCVFTGPSKQPLPLNIHAQLQNYKGTRVQKMDSEKALLNYFIIQFAKIDPDLIVGHDLVGLQIDILANRLIKRDVSTFSKLSRVKRAEKGRLVQDLFTGRLVADLKISAKELIKSRTYDLPTLCQQVLKLREDQITDLEPDEVVRMYENTEDIFKLIEYTMQDTAYMLKILYDLNIIPLALQITNIAGNIMSKTLMGGRSERNEYLLMHAFQEKDYIVPEKKFKRRRNNNDSQQVAKKKPAYAGGLVLEPKIGFYDKLLLLMDFNSLYPSIIQEYNICFTTLPTTDEDNNLVLPDKNLPPGILPVEIKKLVDSRKQVKKLMATPDLSPDMWMQYNIRQMALKLTANSMYGCLGFANSRFYAKNLAALVTQKGREILTNTKDLVEKMMFEVVYGDTDSIMINTNLLDYDQVLKIGNKIKQEVNKYYKMVELDVDGIFKYLLLLKKKKYAAVTLKRTNDGQLQEEKEYKGLDIVRRDWSRISSEAGKQVLEYILSDQTEDERLINIQNYLRKLREDLEEGRMPIQLLEITKQLAKDPKEYPNKDNFAHVLVALRYNQEHRGHLRVGDAVCYVICEDGTNNSATKRGYHPEELKIKEHLKIDVKYYLSQQIHPVVARLIDPLEGIDADVIAECLGLDGTVYKKAVAKKPQDVGENIMLPEVKFRNCVKFTFKCLVCQEENIVNGPLNEDKVPFLTKCSNPDCTAKPIDYLYHIQNQLCFKINEFIRKYYNNKLICEDPSCTTETNKLPIKFMSKYPVCQGCQQGVLYRDYTEAELATQLEYFVYIFNLANLNKKPLLEDSIERGYHQLVETVSSYVKRSAYSVVNLKEVFEILEKIGSEKCIR

SEQ ID NO: 12222 - protein, 463 aa, Ceutorhynchus assimilis
MASAAAAKIAEVRETTRVERIGAHSHIRGLGLDDCLEARPVSQGMVGQLSARRAVGIVLQMVREGRIAGRAVLLAGQPGTGKTAIATALAAALGSDTPFTSMAGSEIYSLEMSKTEALTQAIRKSIGVRIREETEIIEGEVVEVQIERPATGMGTKVGKLILKTTDMETVYDLGGKMIESVLKEKVQSGDVIFIDKATGKITRIGRSFARARDYDATGAQTRFVQCPEGELQKRKEVVHTVTLHEIDVINSRTHGFLALFSGDTGEIKPEIRDQINGKVAEWREEGKAEIVPGVLFIDEVHMLDIECFSFLNRALENEMAPIVIMATNRGITKIRGTTYKSPHGIPLDLLDRTIIVPTSPYEENELKEILSIRCEEEDCQMSDNALTVLTRISKETSLRYGMQLIMTSSLIARKRKAHEVDVEDIKRAYQLFFDEGRSVQFLKEYQQEFMFHELDDDMRMELS

SEQ ID NO: 12223 - protein, 371 aa, Ceutorhynchus assimilis
MAIRTYGDKPITFQLEENGEYYCVGSEVGNYLRLFRGSLYKKYPGMFRRSITNEERKRLIDLGLSQHCLASSVSLLRASEVEDIIEGNDDKYKAVSVHTSDPPVPREGKSKKNQQWVPSLPNSSHLDAVPQATPINRNRVAAKKVRTFPLCFDDTDPQLNIENGCQQEVLVPIRLDMEIEGQKLRDTFTWNKNESLITPEQFAEVLCDDLDLNPLTFVPAISQAIRQQLDAFPPEPPSIIEENADQRVIIKLNIHVGNTSLVDQVEWDMSEKQNNPEEFALKLCSELGLGGEFVTAIAYSIRGQLSWHQRTFAFSEAPLPTVEVPFRTPSESDQWAPFLETLTDAEMEKKIRDQDRNTRRIRRLANTTPGW

SEQ ID NO: 12224 - protein, 207 aa, Ceutorhynchus assimilis
MFCCWSQQEDFGKGPMAAIRKKLVIVGDGACGKTCLLIVFSKDQFPEVYVPTVFENYVADIEVDGKQVELALWDTAGQEDYDRLRPLSYPDTDVILMCFSVDSPDSLENIPEKWTPEVKHFCPNVPIILVGNKKDLRNDPTTINELKNMKQEPVKPQDGRSMAEKINAFAYLECSAKSKEGVREVFENATRAALQVKKKKKHRCILF

SEQ ID NO: 12225 - protein, 1381 aa, Ceutorhynchus assimilis
MINTSSTMNSTQKSQNTQFPLPKMEVAASQIDKALAEDACAPKLIDLMNINAETGPTYTGFVDSDYPVLSNNDMHNMALGDLVQIKNVSSNPLPPGISDHFSQAQYQCTMGLFPEINRAWLIADSDLYIWTYETNIDMAYFDGISQTILCVGLVKPKPGVLHEFIKYLLVVATATDIIVLGVTFTEAKYGVEEEMHLIPDPVFSISTDGNTITTITAANNGRIFFGTKEGSLFEITYQTASGWFGKRCKIVNLSTSRLSFLVPSFINAALGEEDGIFQIVIDKSRNILYTLTEKGAIEVCDLGERGNSFSRIIKLSQKSIVHQVLHTVTTLDSGAFRPIVSIAPIEAYESTNLNLVAITKSGVRFYFTVTGLSYQQPNARPYALTLAHVRLPPGFSANITVRPRDVHIGYYRDRNAILLTTVNHKDVLWCLSSDLFPFSYNLKEAYTTINLDAPALAMAEIRHEDFLHLNPQNEEEPPLVVRQHAEAPKKYVVLTSHSVQVFIKLRPVDMLKQILLDSNGQDTLPLTTFFSIQSEVQACATSLILASLLSEENVEIAELATRAFFLFGGEPQLIQANQQNIHQQNTTLLGSTMFSPQIISTPAPQNQQYHMQRTQSPPGYMFNVTQRPQMGSYVAERPQSPNYMTTGSVMQQQQQQSFVQPFDPSIFINFSHKHNGLYLYLCRILRLIWNRHCVERFCPDGEFALFQSSISVEDCIKLQNNLNALHNFLTLNTDFSGTTNQMAIHNNSTLNQTLVRQPVTLQDAQLIERKSLDALKTFLCHCCQIMGLWRILCDHQFHELVACLPDNDQEILQKTTFKELFLFRKDICTVLIQTLVNSYLGDNASVDAISNRLMEVCPHLYKPEDAAFTKASELLKTTRGIQNVDEREEKLLTALQLCKNIAPNVKLPVVCKQFTALKAYKAVIELCAYCARRIDPDNIAKSYFHSEDDDADEDGLKMYHKRMETYREIIVMLETLYCEQDPVQPATYDPDLTNTRSILLDGTEGPKLGESINDIIQTILFYDDEIMHVAVYEWMVSRQMTSDILQIKARSLELYLKKASMQNPNNLVVMNLLWQYYETNSNHALAAKILHNLASRTDINIPLKERLTYLARAIMCMRCDKTGYSVDSGMFLRDLEDKIEVAKVQNLILEDITNFRTQIATADEAISALNSGLYEISQLYENFAEPFNLLECKLAIIDCAGYTDNNNALATSIWQEILANELRKTTTGGADRIKPILQKVKNLARLYGSSDNSFPLSYITSELEMINAKLRGPKGLVPNTFIEVNIDFQRLIEVYSSLLNLSGNLNFWQNEDHEFHLCESTCALVMSFINNHNAFSSIEKRKIVATCQDTMTTLLSNLYTKANSDALVNQVRNIQTKLSRI

SEQ ID NO: 12226 - protein, 1360 aa, Ceutorhynchus assimilis
MTQFTLGYREVIADQDLIEKWTEIPIFTGGAQSTLQDIKVTEKASGYSYADSNRYYTRNRFIYWRIDSDILELIEHSLDINLTGNKLRYKFIDSPILDGVSVKETEDHIFILVPTVCSVHKFTFPHPSKYHRQDELLDSHLKLAAPSIFCNAIHTGDDPTSYYVFNNPSTANDQLPNLAKSFYNPDTEEAVFILAYPSAELLLIKLNSQGRALCMELKGESLMPRFLSGITEKFRSKHKDGNQIISALIEVFEYEVYALTLARNGHLKFWSCRNGQCVAAIDMMPQGSDRLQNALLRKAEGNVESYSPIAIFMSFPSRGQFHILKPIINNEQITIEVVRVIESVEKMVLDFSLQSNQIWLACVTGNTQCSVYMRPMEGGGTWRPVIKEAVHEKEALDGKSDPRQVYSQHLFHPGRFPLYTLNKSLGTLMKNEVKLTSVAALKQAICLAIENDIQNQFADIEDITDEEYLEKAKWCWEKFYSSCCQYYQISLKPLGLMLLPQNSAAILIRKATFSLVRPMEPLEHMFLCNDSGFKDQFINFALLGEEQDLLDNVKKLFDLIVFIESQMSKNLKTTFEREIGITLQPKLVVSSLCEILRKEHPSIRDQVNELKKVKDLYKAIHKLLDLLRHDSTPANPDNESNPQAMHYFSSALGISFVSTCLRQQCQNRFAICRNLLIICHSLNNVDAVTRDIRQACESDIIELTQANYVMLWLANLPAFNNVAQESALQRLNTIKLTPAFNVTRNIFSLLEAFISSTGGYEARKMLSKMDYHGEARAHWHLSLLPFISNLRTILWPLKTGTILPEWLVSSGQHLWLQQYTRLLSPWCVQNKYSCKFLLAASFLTCAENHKALKLFQAASDGILVEPFLQKLIKDAHEGQEKIFYYLKVIHLFELHKSRDCAIQMAVYALKAIEPESALVPTLYSIKFKHHLALRHYKWAFDDLKANPDLERRKDNLRDLVKTLLDEREFDVLLGFTYGDMEELFTNILFTRARATDALNNVFYDILYSHQINRGSLYYRLAASIKYEQSFRLSRCNTVQALEKQVKCCLIAKNVLQLTDPEYAWVIRPSDPDEEETEIIMESLAGSGKDFEVFRIKKQVEVVTVDTMEKELVFLMAKLKLIKFHPEASSKITNIYESEELVMHLNNAGLFKEALQVCKTYKLSYASVFSDLTGRCVILSEDENSYPCDWLSENDFQDLSAYRNNYSTLAWELLQKLLKECEEPNLTVLHKVVTEKIISMRMYLPFWLKVSYKKRNSGELLRLLHLSGHLDEAFELCREYLLLALTSLSPNSQAFCMPVYEIQSLVYQLKLQNEKHFNRPFKNELKTLSELFQKYLTSAMRISNEKAQLQMSTFGTIPLNR

SEQ ID NO: 12227 - protein, 969 aa, Ceutorhynchus assimilis
MEISDENLQTLARYLQETLNPEVNVRRPAEKFLEGVEVNQNYPLLLLNLVHKPEVDMTVRIAGSVAFKNYIKRNWTVQEDQPDRIHESDRAAIKSMIVTLMLTSPESIQKQLSDAISIIGKTDFPVKWPELITQMVEKFATGDFNVINGILRTGHSLFKKYRFEFKSNELWTEIKYVLEKLAQPLTNLFVATVNLTQTHANDVNALQTIYSSLVLISKVFYSLNFQDLPEFFEDNMQIWMQHFHLLLTVEAKNLQSDTDDSVGVIEQLKTQICDNIALYAQKYDEEFREYLPQFVTDVWSLLVGTGLEPKNDLLVSNALQFLSTVAERNHYRNLFEDDQVLSSICEKVIIPNMEFRESDQELFEDNPEEFTRRDIEGSDVDTRRRAACDLVNTLSVHFEEKIMKIFGQYLQVMLAKFAENPKSNWRHKDAALYLVISLVSRGATQKHGVTQTSKLVDISQFFQQNIVAELQRPNVDELPVLKADAIKYLMTFRSVLPSTLVVSSLPQLIRHLSCESAVVHTYAACCIEKILIMRDSNNHPHVTGAQIQPFAAELISQLFGVLEKPVSEENEYVMKAIMRTFSTLQDLVIPFLGASLPKLTEKLQAVAKNPSKPHFNHYLFETLSLSIMIVCKSNQAAVKSFEDILFPTFQAILQQDIQEFIPYVFQIVSLFMEYTPAGNIPESYMQLLPCLLAPVLWERPANISPLVRLLRAYITQAAPQIIAQDKLSGFLGVFQKLIASKSNDHEGFYLMQSMIQNIPKETLAPFLKQIFFLLFQRLSSSKTTKFVVGFIVLICLFMVKYSASELIMLIDGIQPQMFGMVLEKLLIAEIQKVTGRIERKIVSCGVSKLLGESPEMIDGIYGKYWPQLLQALLVYFEMPPDESTLPDDHFIEVDDIPTYQTSNARLNFANTTKEDPLPNVSEPRQFLVQSLKSLSNSQPGRVPTLISNTSTQSQTCLQNYLAKFGVQLV

SEQ ID NO: 12228 - protein, 196 aa, Ceutorhynchus assimilis
MAKVQLCNITVMDNPSPFLNPFQFEITFECIEELKEDLEWKMIYVGSAESEEFDQVLDSVFVGPIPEGKHMFVFQADPPNVSRIPENDALGVTVVLLTCSYRAQEFIRVGYFINNEYSDPELKELPPSPPQFNKVTRNILASEPRVTRFKINWEEPNAQESMPGPSENAEPIPIPPLGQTPSFNESSNSWATMECS

SEQ ID NO: 12229 - protein, 315 aa, Ceutorhynchus assimilis
MDQMLPSPGFSIPSIGTPLHQLEEDQQILPNALQQQQQPITSQVPPLAPMGGLTPTLSLGMGNAIAMPHTKYVTGFSMPMGGNNSGMTPQTPQHSMMTSMVNLGGTGGSTPSMTPIVGGPSTPSPMTPMTPHSADPGIVPQLQNIVSTVNLNCKLDLKKIALHARNAEYNPKRFAAVIMRIREPRTTALIFSSGKMVCTGAKSEEDSRLAARKYARIIQKLGFNAKFLDFKIQNMVGSCDVKFPIRLEGLVLTHSSFSSYEPELFPGLIYRMVKPRIVLLIFVSGKVVLTGAKVRQEIYEAFDNIYPILKSFKKQ

SEQ ID NO: 12230 - protein, 158 aa, Ceutorhynchus assimilis
MAAMRSMSRLLTSRALNTTIRRGYAEEMNFTFAAGNQVFYDGKSVKQVDVPSFSGSFGILPKHVPTLAVLKPGVVSVYEEDGGVKKIFVSSGTVTINEDSSVQILAEEAHPIENIDASAARELLTKSQSQLSSAANDQAKAEAEIAIEVSEALVKAAE

SEQ ID NO: 12231 - protein, 329 aa, Ceutorhynchus assimilis
MSGDGDKAEQFDSLFLTIAQHHPEGALKLLDTFVSFLGRKTDFFTGGNEGDWEKLVMNTFKKHERISRSSREAELKAKKEKEAARKAKKEAKKLEEQSVQPAEIKELTDEEAEKLQKELDTKQSVESVATSSAVGTSSETTDEVTEEEEDESEKGKIKPNKGNGCDLGKYKWTQTLQDIELRIPLNKNYQVKGKDLVVNLTKKHLVCGFRNEPPIIDDDFQHEIKLEESTWVIEDGKTLLFNLEKINKMNWWGKLVMSDPEISTKKINPEPSKLSDLDGETRGLVEKMMYDQRQKEMGLPTSDEQKKQDAIKKFMEQHPEMDFSKCKFN

SEQ ID NO: 12232 - protein, 152 aa, Ceutorhynchus assimilis
MAGHSGAPPVLQWSPDKTHSDRERWVCLYPAYINSKKSLAEGRRIPRNKCVENPTYQEIRDVLAAAGLNVGVENKLYSRERSKELLYRGRIRVQLKNDDGSLVNPAFSSRDTLMLHLGDMIPKLKTRLHKPSTDQPSQASQGKGKGKGKGRR

SEQ ID NO: 12233 - protein, 683 aa, Ceutorhynchus assimilis
MEGKAQKMPKVAKVKNKAPAEIQITAEQLLREAKERDLEILPPPPKQKISDPAELADYQLRRRKQFEDNIRKNRTVISNWIKYAQWEESQKEIQRARSIWERALDVDHRNITIWLKYTEMEMRCRQVNHARNLWDRAVTILPRVNQFWYKYTYMEETLENIPGARAVFERWMEWQPEEQAWQTYINFELRYKEIDRARQIYERFVITHPQVKHWIKFARFEENHAFIHSARQIFERAVQFFGDDYMDEKLYIAFAKFEENQKEHDRARVIYKYALDHIPKEETKELYKAYTIHEKKFGDRSGIEEVIVSKRKFQYEQEIAANPTNYDAWFDYIRLVEGQGETDIIRETYERAIANVPPLKNKDFWRRYIYLWINYACYEELEAQDYDRTRQVYKACLELLNHKVFTFSKVWLLYAKFEIRQKNLTSARKILGMAIGMCPRDKLFRGYIEIEIQLREFDRCRKLYEKFLEFGPENCVTWMKFAELETLLGDFERARGIYELAINVPRLDMPELLWKSYIDFEIAQEEPENARQIYERLLERTSHVKVWLSYAKFELNQESDDGMNIRLARRVFERANENLKSSPDKESRALLFENWKEFENMHGDETSLNKITNMMPKRIKKRQKVIDEEGNEQGWEEVFDYIFPEDESNRPNLKLLAAAKSWKQKMEKEATKEVIVSANDNNE

SEQ ID NO: 12234 - protein, 476 aa, Ceutorhynchus assimilis
MGIKFLEVIKPFCSILPEIAKPERKIQFREKVLWTAITLFIFLVCCQIPLFGIMSSDSADPFYWIRVILASNRGTLMELGISPIVTSGLIMQLLAGAKIIEVGDTPKDRALFNGAQKLFGMVITVGQAIVYVMTGMYGDPAEIGAGVCLLIIIQLFVAGLIVLLLDELLQKGYGLGSGISLFIATNICETIIWKAFSPATVNTGRGTEFEGAVIALFHLLTTRQDKIRALREAFYRQNLPNLMNLLATILVFAIVIYFQGFRVDLPIKSARYRGQYSSYPIKLFYTSNIPIILQSALVSNLYVISQMLAVKFQGNILINLLGVWADVGGGGPARSYPIGGLCYYLSPPESVSHILEDPVHAFLYIVFMLGSCAFFSKTWIEVSGSSAKDVAKQLKEQQMVMRGHRDNSMIHELNRYIPTAAAFGGLSIGALSVLADFMGAIGSGTGILLAVTIIYQYFEIFVKEQSEMGGMGTLLF

SEQ ID NO: 12235 - protein, 160 aa, Ceutorhynchus assimilis
MVSVSAASVELSSYRDQHFKGTRAEQDKLLRLSCTLYVGNLSFYTTEEQIYELFSKCGEIRRIIMGLDKYKKTPCGFCFVEYYIREDAENCLRYINGTRLDDRIVRTDWDAGFIEGRQYGRGKTGGQVRDEYRTDYDAGRGGYGKLIQQKIGTEVPSFLR

SEQ ID NO: 12236 - protein, 307 aa, Ceutorhynchus assimilis
MAARVGRICGAGLFKSNTTSSLNQISSYSTTRDWSRGRKALVGSLGILAGGAGAIIFALDRSVRASELELHPPKNPWSHNGWFDSLDHASVRRGYEVYKQVCSACHSLRFIAYRNLVGVTHTEEEAKAEAEEQMITDGPDEAGNMFKRPGKLSDYIPSPYPNEEAARAANNGAYPPDLSYITLARHGGEDYIFALLTGYHDAPAGIALREGQYFNPYFVGGAISMAQSLYNEVIEYSDGTPASASQLAKDVSTFLKWTAEPEFDDRKRMMVKAIGIFTILTMVSYYAKRFKWASLKTRKIEFKPKSK

SEQ ID NO: 12237 - protein, 560 aa, Ceutorhynchus assimilis
MMSIQAYSGSSSSGDEETPAAPPPVSFSAKTLQICAAPTVLPPAIDEDKIHIHPDTVELQYNPKYEELFAPTVGPTNPFKPKHQEIEKNTLSGHVEPAHVSEFQFENQRRTFASYGYALDPSISAHEQGLTKVIGDSEEATDSLKTVFEKTQLRPLDKRKRKKNDKPDDIEGFLGPWGGFEDEQKIARPTEEEQAELQELVSKRTKKGKEPEEKHTEEKSVLHIKDAIDYQGRSFLHAPHDVGVNLKSDMPPDKCFLPKSHIHSWTGHTKGVSAIRWFPKTAHLFLSSGMDCKIKIWEVYKERRCVRTYYGHRQAVRDINFNNNGNQFLSAGYDRYIKLWDTETGRVVSRFTSRKIPYCVKFNPDYNKQHLFVAGTSDKKIICWDTRSGDIVQEYDRHLGAVNTITFVDEHRRFVTTSDDKSLRVWEWDIPVDMKYIADPTMHSMPAVTPAPNGKWLACQSMDNKIVIFSALNRFKLNRKKTFTGHMVAGYACQLDFSPDMSYLVSGDADGKCYIWDWKTTKLYKKWKAHDNVCISCLWHPHEPSKMITAGWDGLIKYWD

SEQ ID NO: 12238 - protein, 269 aa, Ceutorhynchus assimilis
MDQKKPQKKTGGKKVAEAPLAVKKVEAKKEVTPLFEKRPRNFGIGQDIQPPRDLSRFVKWPKYIRIQRQKAVLQKRLKVPPPINQFTQTLDKQTATQLFKVLEKYRPETALQKKNRLKAKAEAKVAKKEEAPSKKPNTLRAGTNTVTKLIEQKKAQLVVIAHDVDPIELVLFLPALCRKMGVPYCIVKGKARLGLLVRRKTCSAVALTQVDSGDRSNFNKIVEAIKTNFNDRGDEIRKHWGGGLLGSKSAARIAKIERAKAKELAQKQG

SEQ ID NO: 12239 - protein, 332 aa, Ceutorhynchus assimilis
MATLKKDIQLPENLVKKILFKKHIDFINEYGKDENNFEYGMTDYLRVSGMYWGLTALELMKAQPVQSKDHIIAYIKQCQDPQSRGISACIGHDPHILHTLSAVQILAMYDKLDAIDCEGVVKYVQSLQQPDGSFSGDKWGEIDTRFSFCSVMTLTLLKKEDAVDLDKAVEFVQSCKNFDGGYGSRPLSESHAGLVYCSVGFFSLTKRLDLVDRDTLAWWLCERQLPSGGLNGRPEKLPDVCYSWWVLASLAILGRLHWIDGEALKNFIFACQDTETGGFADRPGDVADPFHTVFGIAALSLLGQENVQKVNPTYCMPQHVIKRMGLNPEILS

SEQ ID NO: 12240 - protein, 908 aa, Ceutorhynchus assimilis
MHQETLQLVQVLEKTVSPDKNDQDQASSFLEQAAATNLLGFIKTLSDVLRHGGNSSVARMAAGLQLKNQLTAKDLSMKDQYQQRWLAFPADVRTYIKKNVVGALGTETNRPSSAAQCVAYIGVAELPKGDWPDLISTLVANVVNATSEMQKEATLETIGYICSEIDSDVLVSQSNDILTAIVNGMRVTEQNNHVRLAATRALLNSLEFTKANFEQPTERNYIMEVVCEATQSPEAQIKVTALECLVKIMTLYYQHMEAYMCAALFPITLEAMKSENDAVALQGIEFWSNVSDEEVDLSIEDSEAQEAGRPPSRVSRHYAKGALQYIVPILLQKLTKQEELDDEDDWNPSKAAGVCLMLLATCCEEEIVPHVLPFIKDNIKSDNWRYRDASLMAFGSILGGLDSATLKPLVEQAMPTLIELMYDSSVVVRDTAAWTFGRICEIIPEAAINEAFLKPLLESLITGLKAEPRVGANVCWAFSGLAEAAYEAANRDIGGGDDPTPETYCLSQYFEFIVQRLLETTDRPDGAQANLRPAAYEALMEMIKNSPRDCYVTVQKTTMIILERLQQVLQMESHISNHNDRSQFNDLQSLLCGTLQSVLRKVTPEDAPQISDAVMTALLTMFNSNKSGGVQEDALMAVSTLVETLGEGFLKYMDAFKPFLYLGLKNHAEYQVCGTAVGLTGDIFRALRFKALPYCDEIMTLLLENLGEPSVHRSVKPQILSVFGDIVLSIGAEFKKYLEVVLGTLAQASQAQVDRSDFDMVDYLNELREGVLDAYTGIIQGLKGDGPTPSSEVAALEPHIPFIVQFITIVAQDTEHSDGTVAVAAGIVGDLCTAFGPPMLPLLDLVPINDMLAQGRRSRVGRTKTLATWASKELKKLKYAQTNSLVRLRPVGNLLRCSRNFIENSTIS

SEQ ID NO: 12241 - protein, 500 aa, Ceutorhynchus assimilis
METILEQQRRYHEEKERLVDAMVKENLHKKNSYREQINSDQRLKYLLDRYVMSTNKLIDLYDDKDGQRKAEVASLTGPNEFNEFYSRLKQIKDFYRRHPNEISVPMSVEFDELAKARENPTEEMSNLVEFTDEEGYGKFLDLHECYEKYINLKGIEKVDYISYLSMFDQLYDIPKERKTGEYRKYLNCLIEYLCWFIQRIKPLLHLDILLDDEARKAAIEWETDSCPGWPKEAGSALANVGAHLDLSAFSSWEELASLGLDRLKSALMALGLKCGGTLEERAQRLFSTKGQSSLDPALMTKTTKGKASKEKELLRQRDLAMMEAQIYKLSEIVSDQRVATKENVQRKQARTDGERDDSENEESEDESGDENDDDVPYNPKNLPLGWDGKPIPYWLYKLHGLNISYNCEICGNFVYKGPKAFQRHFAEWRHAHGMRCLGIPNTAHFANVTQIEDALALWEKLKVQKQSERWQPETEEEYEDSQGNVVNRKTYEDLKRQGLL

SEQ ID NO: 12242 - protein, 216 aa, Ceutorhynchus assimilis
MTIGKNNKMIQHINYRVRITLNDSRTFIGTFKAFDKHMNMILGDCEEFRKIKPKNSKVEREEKRVLGFVLLRGETVVSLTVEGPPPPEEGLPRVPIPGATSGPGIGRAAGRGMPAGMSGVPVGLQGPVRGVGGPSQQVMTPGGRGQMAGPPQMNHGPPRMGAPPPGMMGGPPPGMMGMPPNAMGMGRGGPPPPPMGIRGPPPGMMRGGPPGPPRGY

SEQ ID NO: 12243 - protein, 392 aa, Ceutorhynchus assimilis
MDAQLCTSGVVAVAAYCLIQRKKARKRRFWVHPIVNQRLLKGAFVTLYSELREHPRKFFNYFRMSTTTFDELYVKLESKLIHKNVVRLSISATERLCVALRYLATGNTFTDLHYTYRLGISTISIVVEEVCTVIWTLLKDECMGIPSTEKWENISMEFEERANFPNCIGAVDGKHIRIIKPTKSGSLFFNYKHFFSVLLLAVCDANYCFTYIDVGAYGKFSDSTVFKNGPFWQKLQNDSLNIPKGKPLPKESIAQPYVIVGDEAFPLTKNLLRPYARKNLNYKKKIFNYRLTRARRYIECTFGILSNKWRIFHRPLNVSLRLSKKIIKACCILHNFVRVRDGFKFEDTLTVHGFRDSTQRIPQNSTINTTRDAFANYFIGSGQVAWQDSKIN

SEQ ID NO: 12244 - protein, 5272 aa, Ceutorhynchus assimilis
MDELPPVLDPDELMDLEEPETYEIEDDDEEIVEDPSSSPFQQFSSGPASNATSAASSPHTNDDFPPPFNFNGKPVTIKRGRGRPRREGGKPTPRRSGGVGVPRVRRAKSAGFSRCRGSRSVRQPDRMDFDFSYISPTSIDDMGLTDIDGFFFPERERPSPVFEELPYAPEVWPGKVCAFCNLGERSQLGQGEIMRLNCPDGFTPQRSVGESNTPAVQLPDRDFGDKSPRGPVTCRRNKNFNRSRSFVSNNEHIDELTIIGHAEEPSVNILYEISGQFYVHRNCALWSNGVTRTEHQALENVGPVVLKSSSQKCSFCNHFGASLTCRSTGCTKVYHFPCATASGAFQDITSLQVFCTNHLHEAALCSESAICYTCKSVGDISNLMYCSSCGTHYHGSCVGLAQLPGVRAGWQCRKCRNCQVCRMMGDETKLMSCEQCDKVYHASCQRPLVTSIPKYGWKCRCCRVCGDCGSRTPGAGLSSRWHLHYTVCDSCYQQRNKGCCCPICQRAYRSHAHREMVQCGTCRKFVHGTCDPEADLVTYQQKKEINPDYEYHCVICKNSLQQLSSRPVTSKRSSLDDFGDLSASQESLYDDISEFDMPSEESFRGTGLGKGKPYASKIAKKKLSYSTGMPGRPKGSFGKGNPGKQGFMKRQRLVEFGRKRGAKAKIRGVFGVPGVGLSRPVSDGKGDEEPGVENRLVLCSAKDKFVLTQDICVMCGALGTDQEGCLISCVQCGQCYHPNCVNVKVTKVILTKGWRCLDCTVCEGCGQRNDEPRLILCDDCDVSYHTYCMDPPLDYVPHGNWKCKWCACCRSCGSTDPGFNSTWMNGCTECGPCASHSACPSCNESYAEGDLIIQCAQCERWLHGICDLIKTEQDAEKCAEDGYTCLLCRPRDVPPPHLIPSSIAPKPPTPTKSPEVRSQPNIFVDGVCLSEWGHSLIKSLSQEYHGTRKKRKKLPPVVHDKEAGIMATIESVVAGGSGGENSFEDTKIELVDMKDEPQELYKEGMIWTKEDGSPPEGFTIFTMESGICVLRRKRQRNLQKLGIGGFLVRMRGFKSQENDEIDTLPGQSTLNFDLPIPMTSTLEGDKPKKKPIRRKQKSKLAETFPAYLQEAFFGKDLMDVTEFKKEMEGGVSSDEDKLFENKQQAIKLTAEELLAVESARQEKTTSEGRSQPRDGFSDTLKIDKPILIKEEEDDTAEDLKDVLALPGDLLDTDLVNSIINEDDELTKNTELDALADDDAELPQTLGSSENSKDAKDELSDILGSHFSLESIPNINSKDVEDIFKGVLTDESQESQLSQEATNMYPSMPSTPTPISPMFPSNSSQLPTAGIIPQMHLPSAPVRPTALPGVQHVSFPPSPYHSEYSNSPQFSPAFSEPPSPWVNINDNTEMDTASVAGVPSTHNQRSSEKMKADEGLGNGATISAVLYANRNHPEWKAEYPVWSDRYKHIIKKWRTLSQDEKAPYLQQARDNRSQLRMKKQQQSQTSKETSTTSPVAPTKPPPTVVPAAALVTNLPSPGLPPPSLVTQAQAQQSPTAITTEDQEKLAQQQRTAREAEQERQWKHLQAMRQQQAQQQAHVIQEQRVQAIARVQRTMSDPNPQFIPTNQTSPLQVTTTSQEGSPVAPPSPRQFIGIKSPPFAHPSPPSTNIRTPTSSQSPVHEFQQPNQQTPNPEESFIEPTSPQVNFSKVPTGNEAFGQPPPPRSPFVAARPPMQARPDQPEIARQLRELLQRQQQQQQLKNFDLVQAKSTQRIWNPNDPPATEPVNAGATAEEITFRQPLPPGSVRPRIPLQLGPRPGPNLRMPQLEGRLQGLDPRLRLILHQSRAALPGQQVPAGGIRFTQGANRPATIEQYEQLLHRQAQLQARNQALEQQGVGVRLPLGQSGGGVIQKQPSSITQAMPVVQPAQQAAATNDQEIPDNVTAELEKLEQETGTMAELQGVSEILGGLGDDDDELLAEMGADFNILEYADPELEALAGEKTNILDLDLEDDNMKQEKKREAMMQRQNNVSSAQTATSQATKTVVASNSQKEQKLEKRPTSTAAEEPHKSDASALPQPNNNPPLPLQKHQQVPQTHQVSQKHQVSQKHQVSQKHQPHSDNNLRPQTPALADQSQNQITQNLSQQRVVQNISSSQPQLAQALANNSNPQQQQQQQLPQPEPPVLQQQLQQQLQQQPPQLQQQQPSPSQHQPNIALTAQQLHQQMLQQVGCKMSKYVQQAAAMGKPMPPGSKLQTPEGIVGIVLANNNVQLQIPPNFQQRLLQTLQNQKLQMRIGRTVPRPQQPNINQPPQPVPGQIARPRMALPTPPPPPPYPGPPPPYPGNLMAQQQAMPQQMGLRMGPGFHHHMGLVHPLALQGFPMHPHFERRPLLLEEQPLLLEDLLEQEKREQEKQNHNHPLPSDINTRSNDSESALCVSDHDFERLKADVFSSGHSDTSSSDSTVGMVQQQWQPNRLQMPSAPTQHTTEVTTKIQMFNANLMPAPPLPSENIVTEQDKQAQLLYEQWLNNQNNVLTQQLRYYETEVLKLRKSKKSLNSKQRQLRKSGNQLTEIDSNELQRISAEQAILQKHLESSRKQSRQHGMLIQEYRNKQQLLQKPLMGGPQTQLASPLGPPGSSPIHHAAASHSPMLSPQQSPLPQQSPLTQHNSPMNSPGPMMVHSPGPGSVAALLQSPGGSVSPIQTRIGTPLSQEGSPGPIQSPSQVCLPPPMPRMTSPQHRRVVTSPVGYTGDMRSGVTQMRFMRPTVEHNSLQRIRGQAPGQLQNFPSKVGTPSPLNSPPLNQMSLAHQQILQKQLHQHQQALLHQQQQQQQQQQQQQQQQQQQQQQQHQQQQQHQQQLQQQQHQQLQQQQHQQIQISDGTQQQEANVMHSPRVAQLIQHRNLGRPQQQQQQQTLTAQQHQLLTKQHQQIALQLQARLNQQSQQQSPTPQSPMPPKSPMHNQNMSPLSMPTSPMPPKSPMLSFNQQQSTPNSPAAHRNSYSQNPTMNQPPSSPMMHQYHQPTSPMIQSPHAIRRPPSSPAMPERPLSVENPGTPRTPYSLDMHLQDNMHTGGGNPNNPNNPIPLPPDGFCYSKLGLRGGMWSGFGRGEKRVPTPPTSSSTSETEKQLPVEVTTLNKPKKEAHINKVSILKKRTPLPKSSPKSIITSKIADFTEYDETSSTSPASTSSLLAGRGGAGLKPLSKQDATGDKLQLPEMVDYEDDNSTILSSEISLCSAAQQNDDEIEITETLSQNDIGEVLSSPMEADQISDEFMLFQENMLVDHLSGIQYSDKEETEEEYANIVIRSPTTSDDEFIMQGRTKKYNILNIAETSGSPEQDTTMEPSTEPEDEEITQPFDESEVVIIEQPVKSPEEQISTKEDFEELIDEGSRKEKMKQDTKSVVEPPQFTAASVYRFPSKTPITVTRTQNVMTTAKVAPKISLITTAPIIQNFTARSEGGKLNAETQQLILTPTTKITTTNAGSKLTSIILTHNPVRSNILNVGQKLVTSSPGITIVSASTSQIASILPSKFSVPIISASAVRQLPNVKVIDKPSSSLSLTPRDSTLPNKIFEDESVSPENANFDDEKKNLFDEKLKAEFTAANGRMPMFGKNVIATNNKNDENNTSQRKNDKSEISNIVTKEKVQVIASPIIAKSVSPVIIHHAPPELKMTAQVIQETSTRMQITATETVSTFMGDGSVEDKSVVISIPSPTPSQEQMLDNIALQALEENRKREFDSFDYVLNMIENMQHSETPEQSDEQNTEKKSTKPAVKEEANESTANKQTMPQLSPLSQPADLTTNMANASQQLRSLLSNIQTTSSSHVPKVETLVKTANKQKIINVTSSTITSPVVASRIIQQATTTSNVSTVIVPNVVKQKVTLAPTSKARTSSTESFLTNRFLGSEPKSTTSTPSQTTETINKSPDLNKKASLTLTAMLQNQPSATPTTKSSPDTITAASLLATPVSLSRTSFSPALALAQPNAIIASSLANTSTSSVISSAFKTITSTNLLHTHLTKSRTKSLDDIKDLKTDDQKSEADIITSIKQELSGCRYLPVTSSSQINKCEDSQNVLLKQLLQNTACASTQSPPPSTTSTITTAPTTEVQKVSPPTLSSLLPPVTKTEVQPTSTPQSRPPMQRGLIRETSFVSSPIIQHTPTSTTVAATTTTQQLHIDIKKCAPVVRPSSRDDLLSPPTPRSCGSQESSLQTPPLIVKKESPASTSTCLSIEGIKKELLDESSQHSEISDLGKADIQIKEESEPGEISDKIIVDKEELKKQKRRMYNQKRRQNQLLNKELNNKPNKRPRKNSKIEEDYDSYIDSVLNQIRHLHPMVVSEPAIVRNHGILPVFGSGDLSKLGTKSFDPRFGDLTGTYGNASIPGYSDFYNTIPYGDEEPIPEKPPASTQRGFYDQEFPLIKFDTEDDKKFDLFSREDTPDSIVSCSSPECDAFDASDRYLGLKLISDDEEEEELSKGRRSPKIPIVKPIAIKLKAAGLFLKEPATTKIASDNNKENILKEMDQEKLKPNPSPSGPVKDNENIKVTLTFTSSAAEDIVGVLRDLANILQIPPPTSYQIVDRTSSPTSQKLGLYRTKGKDGKEGAPIDIQSILNGAAKFCKHCDVVILNNLVKKKPSDLPFLSKDSELLSEGEELYFCGSSCYMQFALMNRSPSIPEDKAAAIIDHLSQKDCQNLKQHGQLQDPFDSKSALVNRLLTENTGFNQYFGGAFKQTMKFGSFKPPEHAKSHRNASVKFWTPGCLQPSHKHKKPTDKEMTEMLYQMGITVTPSKLPDDTRKCMFCQVIGDGVADGPARLLNIDVDKWVHLNCALWSDGVYETVNGALMNLENAMQQSLTSTCIHCSKLGATIRCFKTRCSSVYHLSCAVRENCVFYKNKTVFCMAHVPKHEKDNELTTLSVGRRVYINRDENRQVAAVMHNSDTNNLLRVGSLIFLNIGQLLPHQLQNFHTPNYIYPIGYRIIRFYWSMRNVNKRCRYICSINDNMGRPEFRVLVQERSEEDTEFKDFTPKAVWAPILEKIASIRKENKCLQMFPRFISGEDLFGLTEPAIVRVLESLPGIETLSDYKFKYGRNPLLELPLAINPTGAARSEPRLRHQTHWKRFHRTTGSSSRPLFAPLPSNASAPSSFGESVCPYSKQFVHSKSSQYKKMKQEWRNNVYLARSKIQGLGLYAAKDIEKHTMVIEYIGEVIRSELSECREKQYEDRNRGIYMFRLDDDRVVDATLSGGLARYINHSCNPNCVAETVEIDRDLKIIIFAKRRIQRGEELAYDYKFDIEDDQNKISCMCGAPNCRKWMN

SEQ ID NO: 12245 - protein, 685 aa, Nezara viridula
MSSKHKHKKYEEKEERRKKHKSRYSDDSEDEGERKSSSSRHQYKKKKNDHSHKHKKEKKNKSKRSESSDSSTSSDSSSDNSVKLLKRLHDKHEKMIQQKKKEKELMKVNETPEEKRIRRLLKKEAKERKRKQRMGWDKDYLHYTNTDNPFGDANLLSTFVWSKKLAKDGLTDVSREELERINRIKQEENKIELEKVKKRRQEREQERQEREEAMMRLQRDKEAEQFEAWATQEDQFHLEQARLRSRIRIADARAKPIDLLAKYINSEEEVDAVEMHEPYTYLNGLSIKDLEDLVEDIKVYMKLEKGKNLDYWNDITVIVEDELYKLRKMGKKSDYEAAVGRREGIHESVAKEVSSVFRGKTASQLAAMQKQIEKKISDKGEGIDIGYWESLLSQLKAHMARARLRDKHQENLKQKLELLKAEQRQQEQEIKEEPLDESEQQENENSDEIKEEKEDSEEEHSGGDEDGGESMLKESFGEYEAGAYSPVYVDPASLEPGTLIIGEEEDAQRLEYARQHLTSQESQVGATSEELAMQREARKGMSSDEAIFSVESALDSQVYLWSDKYRPRKPRYFNRVHTGFEWNKYNQTHYDMDNPPPKIVQGYKFNIFFPDLIDKTSTPEYYLTTCPDNPDFAVLRFHAGPPYEDIAFKIVNREWEYSYKRGFRCQFHNNIFQLWFHFKRYRYRR

SEQ ID NO: 12246 - protein, 402 aa, Nezara viridula
MGDANIIDKSMRSVFVGNIPYEATEEKLKDIFNEVGPVLSFKLVYDRETGKPKGYGFCEYKDQETALSAMRNLNGYEIGGRSLRVDNACTEKSRLEMQSLLAGPPIDNTYGESVESDKAPEAISKAVASLPPEQMFELMKQMKLCIQNNPTEGKAMLLQNPQLAYALLQAQVVMRIVDPQIAITMLHKANPSVPPLQPPPVEAIRPVPVPQPAPAVAPPPVVPPIVQTRPVVEPEWVPPARPHQPPHPPTFIPQPGGDLDMRTLDPRVPPVRLNQDQDLRIPPMVPAPQQPPAQPPQPYPQEHVISSTVRDPRQYRDPRTGAAPVPVPPRPVVAQAVVPPRPVAPPPSHITSALPPAASDQEKAALIMQVLQLSEEQIAMLPPEQRQSILVLKEQIAKSTQR

SEQ ID NO: 12247 - protein, 395 aa, Nezara viridula
MTASQAMEPNREKALQDYRKKLLEHKEVEVRLKEMRDQLKDLTKQYDKSENDLKALQSVGQIVGEVLKQLTEEKFIVKATNGPRYVVGCRRQLDKLKLKSGTRVALDMTTLTIMRHLPREVDPLVYNMSHEDPGDVTYSAIGGLAEQIRELREVIELPLLNPELFQRVGITPPKGCLLYGPPGTGKTLLARAVASQLDANFLKVVSSAIVDKYIGESARLIREMFNYARDHQPCIIFMDEIDAIGGRRFSEGTSADREIQRTLMELLNQMDGFDSLGQVKMIMATNRPDTLDPALLRPGRLDRKIEIPLPNEQARLEILKIHAGPISKHGDIDYEAVVKLSDNFNGADLRNVCTEAGLFAIRAEREYVMQEDFMKAVRKVADNKKLESKLDYKPV

SEQ ID NO: 12248 - protein, 258 aa, Nezara viridula
MARRYDSRTTIFSPEGRLYQVEYAMEAISHAGTCLGILANDGIILVAEKRNTNKLLDESVYSEKIFKLNENMICSLAGITADANVLTNELRLISQRYLLQYGETIPCEQLVSWLCDIKQAYTQYGGKRPFGVSILYMGWDKHYGYQLYQSDPSGNYSGWKATCIGHNSGAAVSSLKTDYKEGEMTVKDALALGIKVLSKTLDTAKLSVDRVEVATLSQKNGKCVTCILPTEEVQELINAYEKSEAEANALKKEKTPKS

SEQ ID NO: 12249 - protein, 880 aa, Nezara viridula
MTKIQEPQQEEMSEEDKRLQEELNMLVEKITGTDTHLYIPALESMRDLIRSSTTSMTSVPMPLKFLRSHYGALKEACAVMADKKAQELCASIVSVLAMGQDLPGARECLKYCLQSHQKEVGDWGHEYVRQLEGEIADEWASTEEKDKLLGLVESIIKFDMEHNAEIQACDLLMEIDRLDMLDKLMDLTNYSRVCLYLINCAVYVEEPERGNIVNGVMNHYMRFKEYPRALCLAMQLNKHDLMIDIFNQCQDPLVRKQLAFMVGRQQLSLELSDDLPDKSDLTNIMSNAHVNDHFHSLGRELDIMEPKTPEEVYKVWLEGLVLRPTYNLEVPLDSARHNLASTFVNAFVNAGFSRDKLVSVEDGNKWMYKNKQHGMLSAAASLGLIHLWDVDGGLTPIDKYLYTSEDYIKSGALLALGIVNCGVRNDCDPALALLSDYVLHESVTLRIGAVLGLGLAYVGTKRQDAITLLLPVLSDSRSTPEVVAMAALACALITLGTPHPDVVSTILQTLLDLPVAEMTEGHYSKFLPLALGLCYLGQREGTEATKAALEALPEPLRSLSQHMLKMCVYAGTGDVLVIQEQLQVCSEHYPTPEEKKETDKKDKDKDKDKDESKSSKVKDMTCMQAVAALSVAVIAMGEETGSEMATRIFAQLGRYGEPAVRRAVPLAIALSSISNPQLAVIDVLNKYSHDLDEEVAHNAIFSMGLVGAGTNNARLATMLRQLAQYHAKNTGHLFMVRIAQGLTHLGKGTLSLCPFHTDRQVMNYSAVAGLLITLVSFLDTKTIMLGKSHYLLYTLATAMYPRWLVTLDEHLEPLPVSVRVGQAVNVIGKAGTPKTIAGVHTHTTPVLLAVGERAELATEDYTPLTPVMEGFVILRKKQPA

SEQ ID NO: 12250 - protein, 433 aa, Nezara viridula
MEPPAAEQPQQQPEQEAGVIRQRTITTSGTITTSPQPEASPSPEQPAQEHDARRSGKDVEVPYEIVQLRPGTYDEGYSLEEATRYSPGSGRYYTTDGSVKYERDDKGEGSYVTLEPVNYPPGGAYQEPAAGYYTYKEEEDVYIKADPPLTPKNFAHFDHPVTSHPTQLSAQVTYVTGGGSRGEYVTANQPGYWSSEYVYQQPQQEIQLPPGTPYVFSSNGQATWAIDESYDPNMLSTSDIKECVNCAASVTPLWRRDGTGHHLCNACGLYSRINGVHRPPVRTHHKKVHNIGNRRNGVSCANCQTNNTTLWRRNNTGEPVCNACGLYFKLHGVNRPHTMKKEGIQTRKRKPKNPQVNLPSPKNDIKTTGEKSGSWDKCDNDLLDSGYTMAPSSIFLPSSFLTKPVGVSVSGLESVPPSVIIPPTSSQDTQRTE

SEQ ID NO: 12251 - protein, 1812 aa, Nezara viridula
MSLPGGKMACPGNGIYVIQGEMSVLLTAMKKVNRWSSHVHQDDENDILIRSFTDLKDVLNQIGDLREVEPNHFLSPFLEVIRSEETTGPVTSLALSSVNKFLSYGLIDSKSKTIAATVENIAEAVTRARFVGTDQTNDSIVLLKILQVLRTLLLSPEGCWLTNESVLEILLSCFRMCFEPRLNELLRRCAENCLRDMVQLLFSRLPSFTEDNRKIQQKLKMNTSAPLDSGKGKKKTSRPSSRKVSRKSQDKSPSPVFGSEVSNALKECDIQQLPLPDEPPITSHDKLEPEILTVPTEESLAKIPSNGSLEINSVNNVSNVNNLEEHQNATSSAILDDGVIISIEDSSSQNSESTEQLATIGNLSEVKRPDDLDVNPSETNFASPLDSKAEEEPLISPTTPESPVEGQDWTNQQGVRFTNTESDTTAPSGPYGLLSAHELLRFLASLCNPLDKQNSDSMIHIGLTLITVALEVGADSIAKFPSLLSTVKNDVCRSLLALLNTEKLPIFASVLQVSFLLFESLRTHLKFQLERYLSRLTEIIISDSSKISYEHREIALESVVHLWRIPGLVTELYLNYDCALYCPNLYEELTNLLSKNAFPVTGVYNTHLLSLDALLTVIDSIESHCNSRILNERQNPSKDGEINKLEFHDFASNYIHRTGTRQKLSLNIPSHEQLMAVKRKKKLLATGTEHFNSKPKKGIQFLQEHNLLSTPLDAVEVVGFLRENPHLDKKMIGEYISNRANIAILDQFVKSFDFTEMRIDEALRLYLETFRLPGESPLISLVMEHFAEHWHKCNGEPFANADAAFTLAYAIIMLNVDQHNHNVKKQNTPMSSDAFKRNLKNVNGGQDFEEEMLDEIYIAIKTEEIVMPAEQTGLVKENYEWKVLLRRGTGPEGCYVHAPNGLLDHDLFSLIWSPTISALSYLFDKTNDPTIYQKAISGFRKCAMISAHYGMSNDFDNLIVSLCKYTMLHYSAESPENLTISFGSSPKARRAAKTVFDLAHRHGDIIRESWRNILDCILQLYRCKLLPKILVEAEDFIELSGKISLIREDIQLSPKTETGILSSLYSYIALGAETNTQKGPSVEDQEAIKVAQNCIRECHLEQLITESKFLRIDSLQHFVKALVTASYGPEGHVSLGTSYSEDTAVFFLELLLKVVIQNRDRISSIWCSVKEHIYTLLMGAAACDHHFLVERSVVGLLRLAIRLMHKEEMGPMVLQSLRMLLLLKSSTLSRVSRQVSYGTFELLKTSAANIHSATDWAIIFTLLECVGAGAPPPKVVSKPVSSTESAGARSEGEVQVDSGLGNERGYTSDSELSKAGSVPLSPSLSPEAPLSNTPTGWILVGREGEIQPVSCVRRTMLPELSRYDPLSMVKCVDSLSFLVRDVVHITPYNFHDCIRCIRTFVEAAANTVERKSRKSGRDTARQAKRKSTKRREERGLSPTGSAYDADESDPEDSPGYQQVCIQLLELMHTLHTRTAQIFRWWAEETGQKEVANPSYWTPGWCPLLQGISRLCSHPNRAVRMSAITYLQRALLMQDLQSLSGEEWEECFTQVLFPLLSTLLSVNIPAIEETRIRAATVLSKVFLHHLSPLQTLPSFAQLWLTILDYMDKYMHADNSDLLYEAIPESLKNLLLVMDSAGVFNGLDGRNEIWVVTWDRISSFLPNLQADLFKDHLPVVDASSLETKEALETSKSETEVVQTEQPTLQRPPGSQQSSPLPPLMPKPGEAVEISGPTTNNNVGSQNWQPPAPVYPHLEQMVSTPIGPASHLPVYSGFASMPHQPPPPSAQFFYQDMSSSSPPNMIQSSEQPAGILRII

SEQ ID NO: 12252 - protein, 205 aa, Nezara viridula
MSILAYNGSAVIAMKGKDCVAIASDLRFGIQGQTVSTNFEKIFEMGPHLYIGLPGLTTDTFTVLNKLKFRANMFELKEDRKIAPDVFLSMVSNLLYERRFGPFFVEPIIAGLKPKTFEPFIASMDLLGCPNKPEDFVVAGTASEQLYGMCEALWEPDLSPEDLFETISQALVNACDRDALSGWGASVYIIEKDKVTHRRIKTRMD

SEQ ID NO: 12253 - protein, 925 aa, Nezara viridula
MESSPSLETVHQAVYALYHNPDPAEKEKASLWLGQLQKSVFSWKIADEILHTSTDVECCYFAAQTMRTKIQHSFHELPPGSHLPLRDSLMDHISKINETTNSVIGTQLYLALADLALQMGSWEKPAIDLIERYSMTSVPPLLEMLTFLPEEVNSRALRLGSNRRQELLHKFSLAVPNVSEFLKMCLNNSGNNPQIQIKVFKCFTSWVSVQAMTLNDVTDNIVVATAFHVLANRMASSNLHEAAADCVCSLLECLEDNNNQQSIEMQLFNGVISLEQPFHISVAHEEHEKCVNYCRVFTELAESFLEKIVSGSSPNKAHFAIKIFDLVLTCVGHHDYEVAAITFNLWYRLSEELYQKKNSGLTSLFKPYIERLIEALCRHCQMEPDHEGILEEGDDFPDFRMKVAELIRDVVFIIGSSNCFRQMFISLQGPNTTWDTTEAALFIMQAVAKNIIPEENDVVPKVVEAILNLPPNTHIAVRSTSVLLLGELCEWIEKHPQYLEPVLNMVLFCLQQPQLANSAANCLQSICSTCKNQMVAKFLGLLQILQSLDKFVLTNESVVGLLKGVASILSIMHPDQLQQAMRDVCLIQIKPLVHLIENDVKLEKGTKTDPAVWMDRLSAIFRHINLTVRNGEIHPCQPVITEIWPVLSSVCSKYQANSHVMERCCRCLRFAVRCVGKQSVNLLEPLVKQIVSLYSQHEHSCFLYLGSILVDEYASEPGCIQGLLDMLQAFIHPTFTLLQGEAGLKLHPDTVDDLFRLCARFLQRAPMAFLTSPAINSILECALSCIPLDHRDANSSVMKFFYDLIHAGMTNEDHEDFALRQRLVQNIIQEKGSDLVNNLLTASVFFLQIYMLSDVADVLMELILLDKQAAGRWIEQSLKRMPTHNSTGSITATPKQLQDFHRSLLSACSSKTLTTTLKEFSRLYR

SEQ ID NO: 12254 - protein, 391 aa, Nezara viridula
MAQRFPPSQPTPSPVQQPQRYPTPSGPPLRQYATPTFPGGGMGSGMMPRPQQQPYNPIRPPIPQSQKRPSDVRPPQQQPKGEFPHTSAGGSSGKKKKKLADKILPQKVRDLVPESQAYMDLLAFERKLDSTIMRKRLDIQEALKRPMKQKRKLRIFISNTFYPAKEATETEEGSVASWELRVEGRLLEDSKNDPNKPPPLQVKRKFSSFFKSLVIELDKELYGPDNHLVEWHRTPTTQETDGFQVKRPGDKNVRCTILLLLDYQPLQFKLDTRLARLLGVHTQTRPVIISALWQYIKTHKLQDPHEREYINCDKYLEQTFSCPRMKFAEIPQRLNPLLHPPDPIVINHIISVEGTEQKQTACYDIDVEVDDTLKTQMNNFLLSTASQQEIQ

SEQ ID NO: 12255 - protein, 144 aa, Nezara viridula
MPKVRRSKKPPPDGWELIEPTLEELEQKMREAETEPHEGKRKVESLWPIFKIHHQKSRYIYDLYYRRKAISKELYEHCLNENIADKNLIAKWKKQGYESLCCLRCIQTRDTNFGTSCICRVPKAKLEEGKIVECIHCGCRGCSG

SEQ ID NO: 12256 - protein, 342 aa, Nezara viridula
MKVLLESDVQLTTHFWGASDYKDKLSVAIGEPLVLSSDASWANHILLGHPAMPTATGHSGVIPSNEECGIRDVWAHNLKDEFKVIRKIIHKYNYVAMDTEFPGVVARPIGEFRSSADYQYQLLRCNVDLLRIIQLGLTFLDENGKAPAGPYSTWQFNFKFNLSEDMYAQDSIDLLQNSGIQFKKHEEDGIDPVDFAELLMTSGIVLMENIKWLSFHSGYDFGYLLKLLTNQNLPNDESEFFELLKIYFPTVYDVKYLMKSCKNLKGGLQEVADQLELTRVGPQHQAGSDSLLTGMAFFKMREMFFEDNIDDGKYCGHLYGLGASFVVNGNSFHDNGDNSSNS

SEQ ID NO: 12257 - protein, 401 aa, Nezara viridula
MSDSRRVQLKEDLSFVEFETSENVEVISSFQSMGLKEDLLRGIYAYGFEKPSAIQQRAIIPIVRGRDVIAQAQSGTGKTATFAIAILQSLDTQTRDTQVLCLSPTRELAVQIQKVILALGDLMNVQCHACIGGTSLGEDIRKLDYGQHVVSGTPGRVFDMIKRRTLRTRSIKVLVLDEADEMLNKGFKEQIYDVYRFLPPATQVVLISATLPHEILEMTSKFMTDPIRILVKRDELTLEGIKQFFVAVEREEWKFDTLCDLYDTLTITQAVIFCNTRRKVDWLTEKMRDANFTVCSMHGDMPQKERDAIMKEFRAGKSRVLITTDVWARGIDVQQVSLVINYDLPNNRELYIHRIGRSGRFGRKGVAINFVKSDDIRILRDIEQYYSTQIDEMPMNVADLI

SEQ ID NO: 12258 - protein, 532 aa, Nezara viridula
MTHAAGDGHRSHSNVYKDKSKPQDVRTSNMTAAKGLADAIRTSLGPKGMDKMIQKGNGEVTITNDGATILQQMNVMHPAAKLLVELSQAQDVEAGDGTTTVVILAGAIMEAAEKLMNRGIHPTTISDAFSIAVEKAIPILREMSIPLQQNDNESLIRSASTSLNSKVVSQHSSILAPLAVNAVLRITDPKKDKNVDLKDIKIIKKLGGTVEDTELIEGLVFTQKLANINGPKRLEKVKIGLIQFCISPPKTDMDHNVVISDYAAMDRILKEERAYILNIAKQIKKAGCTMLLIQKSILRDALSDLAIHFFDKLKIMVVKDIEREDIDFVCKTLGCRPIASLDHFTSEALVSAELAEEVSAGSSRIVKVTGIHNPAKTVTILVRGSNNLVLEEADRSIHDALCVIRCLIRERALLPGGGAPEIELSLRLGQHAQVLGSVEAYCLREYAKALEIVPYTLAENAGLNPVATVTELRNKHVHGQTSAGINVRKGQVTDILEENVLQPMLVTASAITLATETVRSILKIDDILNVAH

SEQ ID NO: 12259 - protein, 415 aa, Nezara viridula
MDEIGIVLPEKEENSQDGKLSTILGQNLSDDSDSSDLFTKFKKLQRQLEFLAVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVQYSDIGGMDMQKQEIREAVELPLTHFELYRQIGIDPPRGVLMYGPPGCGKTMLAKAVAHHTTAAFIRVVGSEFVQKYLGEGPRMVRDVFRLAKENAPAIIFIDEIDAIATKRFDAQTGADREVQRILLELLNQMDGFDQTTNVKVIMATNRADTLDPALLRPGRLDRKIEFPLPDRRQKRLVFSTITAKMNLSEEVDLEDYVARPDRVSGADINAICQEAGMHAVRENRYIVLAKDFEKGYKNNIKKDESEHEFYK

SEQ ID NO: 12260 - protein, 162 aa, Nezara viridula
MPNIKLQSSDGEIFEVDVEIAKCSVTIKTMLEDLGMDEDEEEVVPLPNVNSAILKKVIQWATYHKDDPPPPEDDENKEKRTDDISSWDADFLKVDQGTLFELILAANYLDIKGLLDVTCKTVANMIKGKTPEEIRKTFNIKNDFSAAEEEQVRKENEWCEEK

SEQ ID NO: 12261 - protein, 309 aa, Nezara viridula
MEDKTSLKELDQWIEQLNECKQLTESQVKTLCDKAKEILAKESNVQEVKCPVTVCGDVHGQFHDLMELFRIGGRSPDTNYLFMGDYVDRGYYSVETVTLLVALKVRYRERITILRGNHESRQITQVYGFYDECLRKYGNANVWKYFTDLFDYLPLTALVNGQIFCLHGGLSPSIDTLDHIRALDRLQEVPHEGPMCDLLWSDPDDRGGWGISPRGAGYTFGQDISETFNHSNGLTLVSRAHQLVMEGYNWCHDRNVVTIFSAPNYCYRCGNQAAIMELDDAQKYSFLQFDPAPRRGEPHVTRRTPDYFL

SEQ ID NO: 12262 - protein, 309 aa, Nezara viridula
FAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQ

SEQ ID NO: 12263 - protein, 542 aa, Nezara viridula
MQPQIILLKEGTESSQGKPQLVSNINACQIIADAIRTTLGPRGMDKLIVDGNGKATISNDGATILKHLDIVHPAAKCLVDIAKSQDAEVGDGTTSVVLITSEILKQLKPYVDEGVHPRIMMKAVRKATQLCLDKINSLAVKIEKSSAEQHRSLLERCAATALSSKLIHQQKDFFSKMVVDAVLLLDELLPLDLIGIKKVPGGALEESLLVSGVAFKKTFSYAGFEMQPKKYTNPKIAILNIELELKAERDNAEIRLDNVEEYQKVVDVEWQILYEKLDTIVKSGAQVVLSKLPIGDVATQYFADRDMFCAGRVADEDIRRTQKACGGTMITTTKDMSASVLGTCEVFEERQIGGDRYNLFAGCPNAKTCTMILRGGAEQFLEETERSLHDAIMIVRRTIKNDAVVAGGGAIELELSKMLRDYSRTIAGKEQLLIGAVAKALEIIPRQLCDNAGFDATAILNRLRQKHAQGSCWEGVDVALEDISDNMEKCVWEPSVVKRNALEAACEAVCLILSVDETIKNPKSGGGGQGDQPMMPPRGRPM

SEQ ID NO: 12264 - protein, 1741 aa, Nezara viridula
IDRIFRQPQGHLLLIGVSGAGKTTLSRFVAFMNGLSVFQIRVHNKYTSEDFDEDLRSVLRRSGCKNEKIAFILDESNVLESGFLERMNTLLANGEVPGLFEGDEYSTLMTQCKEGAQREGLMLDSNEELYKWFTGQVMRNLHVVFTMNPSHEGLKDRAATSPALFNRCVLNWFGDWSDGALYQVGREFTNTLDLDGPPTWKAPDFFPIAYANLPSPPNHRQAVINGCVFVHQTLHKANQRLTKRGARTMAITPRHYLDFINHFVKLYREKCSELEEQQLHLNVGLGKIAETVEQVEEMQKSLAVKSQELQAKNEAANAKLKQMVKDQQEAEKKKVQSQEIQSQIEKQKLLIAQKREGVMADLAQVEPAVIDAQQAVKEIKKQQLVEVRSMANPPAVVKLALESICLLLGESATDWKSIRAVVMRDNFINSIVNNFSTENISDEVREKMHTRYLSNPEYTFEKVNRASMACGPMVKWAVAQISYADMLKKVEPLREELRSLEEQAGENEQKGEDTKALIAQLEKSIAAYKEEYAQLIQEGLAIKQDLENVQAKVDRSIALLKSLGLERSRWEATSETFKSQMATIIGDVLLSSAYLAYAGYFDQHSRHNLLSRWTEHLSSAGIQFRQDIALTEYLSNPDERLRWQANSLPTDDLCTENAIMLKRFNRYPLIIDPSGQATEFIMNEYRDKITKTSFLDDSFRKNLESALRFGNPLLVQDVENYDPILNPVLNREVRRTGGRVLISLGDQDIDLSPSFVIFLSTRDPTVEFPPDICSRVTFVNFTVTRSSLQSQCLNQVLKAERSDIDEKRSDLLKLQGEFHLRLRQLEKSLLGALNEAKGKILDDDSVITTLETLKQEAAEISKKVEETDRVIGEIETVSQQYKPLSQACSNMYFTLDSLHQIHFLYQYSLKFFLDIFSAVLFSNPSLDGLTDHTQRLGVITKQLFAVCYERVARGMLHTDRLTLALLLSRIYLRGLPQEDQLEAEFHHFLRGKEGVIASSGGASHLEGLSSDQLEALIRLSNRLPQFKELMKKVNEMPEFVAWLQQSTPEQNVPTLWHEDKPLSSIATAMNRLLLIQAVRGDRVTAAGAWLVSAVLGEGFTARAERELDLAHIVESEMTAGVPVLLCSVPGFDATSRVDDLAAESGKQLASIAIGSAEGFSQADSIINMAVRSGRWVLLKNVHLAPQWLVQLEKKLHSLQPHSGFRLFLTMEINPKVPVNLLRAGRIFVFEPPPGIRANLLRTFSTVPASRMMKAPSERARLYFLLAWFNAIVQERLRYAPLGWAKHYEFNESDLRVACDTLDTWIDATAVGRTQLPPEKVPWDALVTLLSQCIYGGKIDNDFDQRLLSSFLSKLFTPRSFEADFALVANVDAGAPGGQRHITMPDGTRRDHFLHWIESLADRQTPSWLGLPNNAEKVLLTNKGTDLVIKLLKMQQLEDEDELAYTEQESGPPSSLQPGTDPGRPAWMRTLHNSALTWLQLLPTSLQTLRRTVENIKDPLYRYFEREVNSGAKLLRDVIHDLTDVVAICQGEKKQTNYHRTMLSDLVKGILPSGWRRYTVPRGCTVIQWITDFSNRVKQLDTISQLASQRGPSEIKNTPIWLGGLMNPEAYITATRQCIAQANSWSLEELILDVTIPEPTPNNSIATDECSFSVTGLKLQGAQCRNNQLLLTSTIMMDLPTTLLRWHRAGGEGDSGKLSLPVYLNSTRSELLFTVDLNIAPGQEPHSFYERGVALLTSTALN

SEQ ID NO: 12265 - protein, 879 aa, Nezara viridula
MAKSSSESSDSEEDRKQRDEFAARLRKKDKENTRKITTIHSDKRAYEEAAKRLKIDSEHQEKLIPRLRVESRRKYLEKRKEDKVLELEADVVDDEYLFNEEELTERERKDRDHKKKLLILAKEHERARELEKVQRYHMPRDVKDSVEQYEEVDERENKPNYEQRKWEEEQMSSAVFHFGAKKKDKSQEEYDLVLDNQIEFIQAMSLAGTKEKPEPQLTEKERKRLTIEETQKSLPVYKFKNELVQAIKDHQVLIIEGETGSGKTTQIPQYLYQSGFTDDGKKIGCTQPRRVAAMSVAARVAEEMSVKLGNEVGYSIRFEDCTSERTIIKYMTDGTLHREFLSEPDLQTYSVMIIDEAHERTLHTDILFGLVKDIARFRSDLKLLISSATLDAEKFSAFFDDAPIFRIPGRRFPVDIYYTKAPEADYIDACVVSILQIHATQPLGDILVFLTGQEEIETCQEILQDRVRRLGSRIKELLILPVYSNLPSDMQAKIFQPTPPNARKVVLATNIAETSLTIDNIIYVIDPGFCKQNNFNSRTGMESLIVVPVSKASANQRAGRAGRVAAGKCFRLFTAWAYKHELEDNTVPEIQRMNLGNVVLTLKALGINDLINFDFLDPPPHETLVLALEQLYALGALNHHGELTKLGRRMAEFPLDPMMGKMLLASEKYKCSEEIVTIAAMLSVNGAIFYRPKDKVVHADTARKNFFLPGGDHLVLWNVYKQWSDTDFSTQWCYENYIQYRSMKRARDVREQLVGLMQRVEMDIISNPTDSIAIRKTITAGYFYHIARLSKGGHYKTVKHNQTVMIHPNSCLFEDLPRWVVYHELVFTTKEFMRQVAEIESKWLLEVAPHYYKPRELEDSTNTKMPKVLGKTRAQLGEH

SEQ ID NO: 12266 - protein, 479 aa, Nezara viridula
ITSRCHSAFKLLSFECWSQLIKKMKIEEVKSTVKTQRISSHSHIKGLGLDENGVPIQMAAGLVGQENAREAAGIVVEMIKSKKMAGRAVLMAGPPGTGKTAIALAMAQELGNKVPFCPMVGSEVFSSEIKKTEVLMENFRRAIGLRIKETKEVYEGEVTELTPVETENPMGGYGKTVSHVIIGLKTAKGTKQLKLDPSIHESLTKEKVEVGDVIYIEANSGAVKRQGRSDTYATEYDLEAEEYVPLPKGDVHKKKEVIQDVTLHDLDVANARPQGGQDVLSIMGQLIKSKKTEITDKLRAEINKVVNRYIDQGIAELVPGVLFIDEVHMLDIETFTYLHQALESAIAPIVVFATNRGRCQVRGAADIISPHGLPLDLLDRLLIIRTAPYTQPEMAQIVKLRAVTEGLSIDEDALSELSDIGSKTTLRYAVQLLTPSNLTAKVNGRSSITREDVAEVGQLFLDAKSSAKILAKHQDQFMK

SEQ ID NO: 12267 - protein, 731 aa, Nezara viridula
MTSIIKFHALSGVMDESPPCYILQVDEFRFLLDCGWDEHFNQDYIKELKRHVHLIDAVLLTYPDHLHLGALPYLVGKCGLSCPVYATIPVYKMGQMFMYDLYQSRYNMEDFNVFSLDDVDAAFDKVVQLKYNQSVTMKGKCYGLSIVPMPAGHMIGGTMWKIMKTGEEDIIYAIDFNHKKERHLNGCDLERLQRPSLLITDAFNATYQQERRRARDEKLMTTILQTLSNNGNILIAVDTAGRLLELAHMLDQLWRNKNSGLQIHPLCLINNVSYNVVEFAKSQIEWMSDKLMKSFEAVRNNPFQFKHIRLCHSVSELNKIPSAKVVLASMPDLECGFAREIFFQWASDSKNSIVLTSRCCEGTLARDLLDNGVGRTIQITVKKRVRLEGEELKEYLKAHKKTNDKNEEKESSESEDEIQLLSVTKGSHDLVIKQERRKKNQKSLKKFYPMFPFIDRKVKFDEYGEFVRIEDYKAPDTAKRPPEKKSKKKDDDILDPADIPTKCVSYEKSLTVNAQVQYIDFEGRSDGESVQKIITQLRPRRVILVRGTSENTEALEKHLLQWSEAKIFCPKKGDIVDATTESHIYQIRLTDSLVSSLHMQKGKDSELAWIDAITKYRQKPSDTMQSTEEMEVEEDGNYSIYNDDYLTLEPLPLTEVNPHQAVFINELKLSDLKQILSRNGIESEFSGGVLWCCNGTIAIRRLESSKVYLEGWISENYYRIREILYGQYAIL

SEQ ID NO: 12268 - protein, 806 aa, Nezara viridula
MPSIDVIQPPPPPPTLEKEEPLLQPTTKPIVGIIYPPPEVRNIVDKTASFVARNGPEFESRIRQNELGNPKFNFLNTGDPYHAYYQHKVKEFKEGKGTEPPPPPPPVQQKTVASATQLKQQEILKQVTEQPFVPKDPPPDYEFMADPPSISALDLDIVKLTAQFVARNGRQFLTNLMNREQRNYQFDFLRPQHSLFLYFTKLLEQYTKVLIPPKDLMSRLKEECSNPTGVLEQVRYRADWLHYQELQKRKEEQALEKERVAYAQIDWHDFVVVETVDYIPGEVGNFPPPTTPDEVGARVLMQERILENGGEDLTEGTGSDDEREKEDSEREEAAGDKGDNTQVQDMEEESSSDSDEDDEQRDQSLQEKQQATPAQKQQALQQNQQHPSADGKKPQPSMQPPLPPAPDKVIVKKGYNPKQHQKTSKGADNYLISPLTSEKIPANKVQEHMRIGLLDPRWVEQRDKHIQDRINQETVYAGGSAIEASLKQLAERRTDIFGVGDEETAIGKKIGEEDKKKDDKVTWDGHTSSVEAATRAARANITIEEQIHQIHKVKGLLPDEEKEKIGPKPVPGAGSSSGGNPMAGGPQIVVQAKAPPLPPPPKVPPLPPPAPLPPPPGLVPQPPIMMVPAPLRPPLMVPPGAFPVVAATPSAFMAPPGTAPLPPAPQPPPQVTQVGNLLKHVASASVGEADDEPMTKKAKTEDCLVPEAQFLIQNKSPVTFKVIVPLLAEKPEWKLNGQALTFTHPLTDTIASIKANISEAIGMPAAKQKLHCDGIFYKDSNSLAFYNISPATVVYLQVKERGGRKK

SEQ ID NO: 12269 - protein, 313 aa, Nezara viridula
MPGVEHVTNKVVVHPLVLLSVVDHFNRMGKIGNQKRVVGVLLGCWKAKGVLDVSNSFAVPFDEDDKDKSVWFLDHDYLENMYGMFKKVNAREKVVGWYHTGPKLHQNDVAINELIRRYCPNSVLVIIDAKPKDLGLPTEAYRAVEEVHDDGSPTTKTFEHVPSEIGAEEAEEVGVEHLLRDIKDTTVGSLSQRVTNQFLGLKGLNQQIQDIRDYLMQVVEGKLPINHQIIYQLQDIFNLLPDMNHGNFVDSLYIKTNDQMLVVYLAALVRAIVALHNLINNKLSNRDAEKKESTKKEEKPKEEESVKKELKAK

SEQ ID NO: 12270 - protein, 540 aa, Nezara viridula
MFQPIFVLSQNSKRESGNKVRTENIAAAKMIAEVIRTCLGPQAMLKMLMDPMGGIVMTNDGNAILREITVQHPAAKMIIEIARTQDEEVGDGTTSVVILCGQIMAEIERHIDEVHPTTIIKEFKRALDDILKILPDISTSLDLKDKAKVIEVVKGCLGTKFLGTWSEMACQMAIDAVDTVRDLKGLGIDLKNFAKIEKVPGGFIEDSKVLEGVMLNKDVTHPKMSRFIKNPRILLLDCSLEYKKGESQTNVEIIKEGDYTRLLQIEEEYIEKMCNHIIEQKPNVVITEKGISDLAQHHLFKAGITAIRRVKKTDNNRIARAVDATIVSRVEEIKPYHIGCGAGLFEVKKIGDEYFTFITECKNPKACTILLRGPSKDVLNEVQRNLQDAMNVVRNLYLDPRILPGGGAVEMALHRALIKANYTIDMEDDCYAAIPSALRIIPRTLLQNAGGKVIRSMNELEKQHNSGILKGVDGITGELKTVEELGVWEPYSVKVQIYKTAIESAILLLKIDDIVSGAKNKDRERNSGSVAQPTEESLKE

SEQ ID NO: 12271 - protein, 232 aa, Nezara viridula
MAMPRSYGGLSDYRTVPAPSFSPYSENGGSVVAVAGDDFAIIASDTRLSTGFQIYTRNQSKLFKLSDKTILGSTGCWCDVLSLTRLVQTRIKMYQYDHNKVMSTPAVAQMLSVLLYYKRFFPYYVANILAGIDDNGKGVVYSYDPIGHHESSKFRAGGTAGALLQPLLDNQLGMLNQENVQDKTYTLEKAHAIVKDVFISAAERDIFTGDRISINIITKDGIREDSFELRKD

SEQ ID NO: 12272 - protein, 299 aa, Nezara viridula
MFGFSMFPFPPRPFKVQYYCFSVAMIPGNERDDVERGGKIIMPPSALDHLTRLNINYPMLFKLHNAKTNRSSHSGVLEFVADEGKVYLPHWMMRNLMLEEGDVIEIESVSLPVATFSRFQPQAPDFLDISNPKAVLENCLRNFACLTTGDIINIKYNQKDYELSVLETQPGAAVTIIECDMNVEFAAPLGYKEPNSEQESLDESSERTENLSNEGSGFTPFFGEGYRLDGKQKKAIEDENMKFKIPTVRGIPDYDWKVGVITFMRNVRQPVKEAQKDDEDKFQPFYGQGHVLSTNRHRK

SEQ ID NO: 12273 - protein, 542 aa, Nezara viridula
MAAFPGSIAFDEYGRPFIIIKDQEKQRRLTGNDAIKSHILSAKAISKIVRTSLGPKGLDKLLVSQDGDVMVSNDGATIMKQMDVDNEIAKLMVQLSQSQDDEIGDGTTGVVVLAGALLEQADVLLDKGIHPIRIADGYELAARAAIEHLDSIATKFPVDPNNLEPLIKTAMTTLGSKIVNKCHRQMAEIAVKAVLSVADLEKRDVNFELIKVDGKVGGRLEDSMLVKGVVIDKDFSHPQMPKVLKDVKIAILTCPFEPPKPKTKHKLDVTSIDDYRALRKYEEEKFNTMVSQVKEAGATLAICQWGFDDEANHLLLKRELPAVRWVGGPEIELIAIATGGRIVPRFEELNPEKLGRAGLVREISFGTTKDKMLVIEECANSRSVTIFIRGSNQMIIDEAKRSMHDALCVVRNLICDDSIVYGGGAAELSCSIATAKQADKISTIEQYAFRAFSEALESIPFALAENSGLPPMQVVTSVRGRQIQENNPALGVDCMGKGTNDMKEQHVIETLKSKKQQIMLATQLVKMILKIDDVRTPNDMQY

SEQ ID NO: 12274 - protein, 113 aa, Nezara viridula
MASAMDVDDEENEVPTSSSGKGEKKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 12275 - protein, 534 aa, Nezara viridula
MVSLNPIRILKHEAEQEKGEMARMSNFIGAIAVGDLVKSTLGPKGMDKILVSYGRNRGQIEVTNDGATILKSVGFDNPAAKILVNMSKVQDDEVGDGTTSVTVLAAELLREAEKLIERKIHPQTIISGYRRATNVALAALDKCAVDNSSNDKEFAEDLLKIARTSLSSKILNLHNEKFSKLAVEAVLRLKGSGNLSAIQIIKKTGGSLDDSFLDDGFLLDKKVGQFQPKRVENARILIANTPLDTDKIKVFGSRIRVDSVAKVADLELAEKEKMKEKIDRIISHKCNVFVNRQLIYNYPEQLFADAGIMAIEHADFDGIERLALVTGGEIVSTFDTPELVKLGECDLIEEIMIGEDNLLRFSGVKLGEACSIVIRGATQQIVDEAERSLHDALCVLVTTVRDKKTVFGGGCSEIIMASAVSDEAINVTGKEAVAMESFAKALLELPMTISDNGGFDSAYLVTALRAAHNKGQITYGLDMKNGGVACMRELGIVESHSVKRQMLLSASEATEVILRVDDILKAAPRKRTEDRGYC

SEQ ID NO: 12276 - protein, 277 aa, Nezara viridula
MFRNQYDSDVTVWSPQGRLHQVEYAMEAVKLGAATVGVKNKQYAVLVALKRASSELSAHQKKIIPLDNHIGMSISGLTADARILSRQMRSECLSYSYSYGTEIPIIRLMNKISNMMQSSTQRYDRRPYGVGLLVAGFDADGPHIFQICPSANLYECRSMAIGARSQSARTYLEKHLADIGNSGTLTDLLKHALRALRDSSPNDTELSSKNVAIAVVGKDTPLKELSEADTQTYLDMILSEERRSGDTAGGSDDAPPPPPPSDPPAQDPTPVVAMETQ

SEQ ID NO: 12277 - protein, 847 aa, Nezara viridula
MPVYQERKPKIVINEEDLPYEEEILRNPFSIKHWLRYIEFKKDAPRNGVNIIYERALKELPGSYKLWYNYLILRKRQIKGRCITDPSFEHLNNTYERSLVFMNKMPRIWMEYCQFLVDQCKITKARHVFDRSLRALPITQHHRIWPLYIKFLKKHNIPETAVRVFRRYLKLCPEDTEEYIDYLTAIHRLDEAAVRLADIVNTDDFVSKHGKSNHQLWTELCDLISKNPQEVRSLNVDAIIRSGLKKYTDQLGHLWNSLADYYIRSGLFEKARDIYEEAIQTVTTVRDFTQVFDAYAQFEELSLSKKMEEVSQKAFPTDDDDIDIELRLARFEDLIERRLLLLNSVLLRQNPHNVHEWLKRVQLFEGKPHDIIYTYTEAVQTVDPKLAVGKPHMLYVNFAKFYEENGQVEDSRIVLEKGTQVPYTKVEDLASVWCEWAEMEIRNENCDEALKILQRATVMPARKVDYHDDSETVQMRLYKSLKIWSLYADLEESFGTFKSCKSVYDRIIDLKIATPQIIINYGLFLEEHNYFEEAFRTYEKGIALFKWPNVFDVWNTYLTKFLKRYGGGKLERTRDLFEQCLENCPPKYAKGFYLLYAKLEEEHGLARHAMAVYERATSAVLPEEMFEVFNIYIKKAAEIYGVPKTRQIYEKAIEVLGEDNSREMCLRFAEMETKLGEIDRARAIYAHCSQMCDPRVTGSFWQTWKDFEVRHGNEDTMREMLRIKRSVQATYNTQVNMMSAQMLSAASNVSGTIADLAPGAKDGMRMLEAKAAEMTVTTKSGSSAIMFVRGEAQNTSQEVQKEIINPEALNVDSDDEEENLEDDDLPVEKQIIPDEVFCGLKKGSDSD

SEQ ID NO: 12278 - protein, 329 aa, Nezara viridula
MAAGPIAERNQDATIYVGGLDDKVTETLMWELFVQAGPVVNVHMPKDRVTQQHQGYGFVEFLGEEDADYAIKIMNMIKVHGKPIRVNKASAHQKNLDVGANVFIGNLDPEVDEKLLYDTFSAFGVILQTPKIMRDPDTGNSKGFAFINYASFDASDAAIDAMNGQFLCNRPVSVSYAYKKDAKGERHGSAAERLLAAQNPLSQADRPHHMFADAPPAPLPPPPVLPPPPVFNPPPPPHMPPPPLPPQRMVAPMPPPPPGPPPPMPPGMMPWPPMQPHFPPPPPPPPTNKAPPLPPPPPPQAWRPPPPPYNRPPFPPPPPPPVRPPPPMF

SEQ ID NO: 12279 - protein, 258 aa, Nezara viridula
MGRVIRAQRKGAGSVFRSHTKHRKGAPKLRSLDFAERHGYIKGVVKDIIHDPGRGAPLAVVHFRDPYRFKTRKELFIAPEGIYTGQFLYCGKKANLHVGNVMPVGTMPEGTIICNLEEKTGDRGRLARASGNYAIVIAHNPDSRRTRVKLPSGAKKVIPSNNRAMVGIVAGGGRIDKPVLKAGRAYYKYKAKRNCWPKVRGVAMNPVEHPHGGGNHQHIGKASTVKRGTSAGRKVGLIAARRTGRIRGGKTDQKKGDD

SEQ ID NO: 12280 - protein, 136 aa, Nezara viridula [sequence omitted]

SEQ ID NO: 12281 - protein, 531 aa, Nezara viridula
MAAITLLNPKAEVVRKTEALSMNQSAAKGLQDVMKTNLGPRGTMKMLVSGAGDIKITKDGNVLLKEMQIQHPTASLIARTSTAMDDITGDGTTSTVLLIAELLKKADNYIIEGVHPRLITEGFTVACKHAMEVLDSMKKTVSLDDKETLIAVARTALNTKVESKVAEVLTQICVEAVQAIKLPDKPLDLHMIEIMTMQSRLESETRLVRGLVLDHGSRHPNMPKKLTNAYILTCNVSLEFEKTEINSGFFYKSAQEREKLVASEREFIELRVAKIIALKKSVCDGTDKGFVVINQKGIDPVSLDMLAREGIMALRRAKRRNMERLTLACGGVAMNSLDDLTEDCLGRAGLVYEHVLGETKYTFVSDCPNPHSVTVLVHGPTSYAITQIQDALRDGLRAVKNAVEDGGVLPGGGAVELKLRHELKKVAEKTKEKYRVGIEAFCDALLVIPKTLAMNSGFNTQEVITQLDYDAKENDSIGLDLQTGKSMIPTDLGILDNYSVKKQYIASSVIVASNLLLVDEVMRAGMSSLKG

SEQ ID NO: 12282 - protein, 1047 aa, Nezara viridula
MSSAEVANNSIEPPAKKRKIATGETAPANSVSKAISAMANNGSFDSNQEIDEGLYSRQLYVLGHDAMRRMASSDVLISGLGGLGVEIAKNVILGGVKSVTLHDETVCTISDLSSQFYLSENSIGLNRAEVSCQLLAELNNYVPTRSYTGPLTDDFIKGFSVVVLTNASEEEKLRVSEIAHASDVSLIIASTMGVFAQVFCDFGREFSVVDTNGENPVSAMIASISRDEEGVIACLDDTRHGLEDGDYVTFSEIQGMTELNGCEPTKIKVLGPYTFSIGNTSNFGEYIRGGIVQQVKMPKVLQFKSYSEALKSPEFIFTDFGKFDHPQQLHVAFKAVESYKKEFGKLPSPWDNKNALDFVNCCKSVLSDLSLDVELNEKLMEQFAKTCSGNMNPIDAFIGGVVAQEVMKACSGKFHPIFQWLYFDSIELLPNEDLAPNDCAPTNSRYDGQVAIFGTEFQKTLGALKYFVVGAGAIGCELLKNFSMMGVGADGGKVIVTDMDLIEKSNLNRQFLFRPHDVQKPKAATAAKAIKKMNPLMNVIAHENRVGPETEKVYDDAFFEDLDGVANALDNVDARIYMDRRCVYYRKPLLESGTLGTKGNTQIVVPFLTESYSSSQDPPEKSIPICTLKNFPNAIEHTLQWARDVFEGLFRQSAENAALYLSDPNFIDRTLRLPGVQPMEVLESIKQALIDDRPKSIEDCITWARNHWQEQYSNQIRQLLFNFPPDQMTTNGQPFWSGPKRCPVALDFDVNNDLHLDYILAAANLKAEVYGIPQVRDRSIIAKIVQNVEVPEFTPKSGVKIAVTDSQMANGAGGQVDQDRIGQLQNELPSKEMFNGLNITPLEFEKDDDNNLHMDFIVAASNLRAANYNIPPADRHKSKLIAGKIIPAIATTTSVVAGLVCIELMKLAKGYKDISLFKNGFVNLALPFFGFSEPILAPKLKYYENEWTLWDRFEVTGEMTLKEFIDYFKDKHQLEITMLSQGVCMLYSFFMAKSKLEDRLNLPMSEVVRRVSKRKLEPHVKALVFELCCNDTDGNDVEVPYVRYTLP

SEQ ID NO: 12283 - protein, 425 aa, Nezara viridula
MADNDDLLDYEDEEQTEQPIVEGSGDTAPRKDVKGAYVSIHSSGFRDFLLKPEILRAIVDCGFEHPSEVQHECIPQAVLGMDILCQAKSGMGKTAVFVLATLQQMELTENQVTVLVMCHTRELAFQISKEYERFSKYMPNIKVAVFFGGLPIQKDEEVLKNNCPHIVVGTPGRILALVKNKKLNLKNLKHFVLDECDKMLEQLDMRRDVQEIFRNTPHSKQVMMFSATLSKDIRPVCKKFMQDPMEVYVDDEAKLTLHGLQQHYVKLKENEKNKKLFDLLDILEFNQVVIFVKSVQRCMALAQLLCDQNFPAVAIHRAMSQEERLAKYQEFKDFQKRILVATNLFGRGMDIERVNIVFNYDMPEDSDTYLHRVARAGRFGTKGLAITFASDEADAKVLNNVQDRFDVNITELPDEIDLSSYIDGR

SEQ ID NO: 12284 - protein, 487 aa, Nezara viridula
MPVEAMQTDVEMKVVDSPSTEDPVATAVQEIREHIRQLEKAVANKEPRFILRVLRLLPSTRHKLSVSVLRNIISSFYLSSPEKDALFLYIEDAVDSDTIQKTKLIKNSNVPLLPEIDAYIHLLVLVRLIDAGKESDAVKCSDALMAKITAQNRRSLDLVAAKCYFYHSRVYELTNQLEKIRGFLHARLRTATLRNDFEGQAVLINCLLRNYLHYKLYDQADKLVSKSVYPESASNNEWARFLYYLGRIKAARLEYSESHKHLVQALRKAPQHAAVGFRQTVQKLAVTVDLLLGDIPDRQIFRQAPLRRSLAPYLQLTQAVRTGDLQRFGEVLEMFGPQFRSDHTFTLILRLRHNVIKTAIRCIGLSYSRITPTSIASKLGLDSPEDAEFIVAKAIRDGVIEATLDPEHGYMQSNEVTDIYRTREPQLAYHQRISFCLDLHNQSVKAMRYPPKSYGKDLESAEERREREQQDLELAKEMAEEDDDVFP

SEQ ID NO: 12285 - protein, 587 aa, Nezara viridula
MALSNPSVPVSEILKSSADSDEPKKKSREDWRKAKELEEARKAGTAPAAVDEEGKDINPHIPQYISSAPWYYSAKGPTLKHQRIQEESVKKFSGIDEWYKRGVDSSKVITKYRKGACENCGAITHQKKDCMERPRKIGARFTGAKIAPDEFVQPELSRDYDGKRDRWAGYDPIQHKMVIERYARIDEAKRQLRADKLNSEQSEEAEEEETKESIADEGGEDEDKYVDEVDMPGTKVDSKQRITVRNLRIREDTAKYLRNLDPSSAYYDPKTRSMRDNPYAGSADTDVDYAGENFVRFTGDTLDHAKVQLFAWEAHNKGVDVHPLGEPTRLEVLKKEFVGKKEEFKQKGQEDLIKKYGGEEHLKAPPKELLLAQTEYYAEYTRYGTVIKGQEKEVVRSRYEEDVLINNHTTVWGSFWHSGKWGYKCCHSFIKGSYCTGEAGRLAASAGEVAVKGPAFIPPHPSTPSASSSSTSSDSSSSSSSSEDEEEKERMKKKQEKKKAKKKKQKVKKLKNKIKNKKPEEKTEEEKLQEALKKEEEAQKEGERLSKMDDRKRPYNSMFEVQKPTDVEMEAYYMKKKRDEDPMANFL

SEQ ID NO: 12286 - protein, 208 aa, Nezara viridula
MGISRDHYHKRRKTGGKRKPIRKKRKYELGRPAANTKLGTKRVHLVRTRGGNTKFRALRLDYGNFSWGSECCTRKTRLIDVVYNASNNELVRTKTLVKNAIVVIDATPFRQWYEAHYALPLGRKKNAKLSEAEEAVLYKKRSRKTENRYKARQKLAKVEPALEEQFQTGRLLACLASRPGQCGRADGYILEGKELEFYLRKIKAKKGK

SEQ ID NO: 12287 - protein, 311 aa, Nezara viridula
MDRLLRLGGGMPGLSQAPPPSDAPVVDTAEQVYISSLALLKMLKHGRAGVPMEVMGLMLGEFVDDYTVRVIDVFAMPQTGTGVSVEAVDPVFQAKMLDMLKQTGRPEMVVGWYHSHPGFGCWLSGVDINTQQSFEALSERAVAVVVDPIQSVKGKVVIDAFRLINPNMMVLGQEPRQTTSNLGHLQKPSVQALIHGLNRHYYSISINYRKNELEQKMLLNLHKKSWMDGLMLSDYSENCKVNETTVGDMLELAKNYNKALEEEEKMTPEQLAIKNVGKQDPKRHLEEKVDVLMSANIVQCLGAMLDTVVFK

SEQ ID NO: 12288 - protein, 405 aa, Nezara viridula
MTYTTFEQMDVDEKKGEGFRSYYITKIEELQLIVAEKSQNLRRLQAQRNELNAKVRMLREELQLLQEQGSYVGEVVKPMDKKKVLVKVHPEGKFVVDIDKNIDINDVTPNSRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILRIHSRKMNLTRGINLRKIAELMPGASGAEVKGVCTEAGMYALRERRIHVTQEDFEMAVAKVMQKDSEKNMSIKKLWK

SEQ ID NO: 12289 - protein, 200 aa, Nezara viridula
MVKLYALHILYKNLNSAVWLKTAYDVQSFGYFQRGTAQDTMAFASKTIVERTQSATRQSVKEGDYICHVYVRADNLAGVVISNHEYPHRVAHTLITKVLDEFSAKYPPSTWASANEANIDFPALAAHLQKFQNPKEADALMKIQSELDETKIILHNTIGAVLERGEKLDDLIMKSESLSYQSKAFYKTARKTNSCCSYVG

SEQ ID NO: 12290 - protein, 248 aa, Nezara viridula
MFLTRSEYDRGVNTFSPEGRLFQVEYAIEAIKLGSTAIGVCTPEGVVMGAEKRIKSTLMEPEAVEKILQVDDHIGCAVSGLMADSRTLVEHARVQCLNHWFVYDEKMPIESAAQAVSNLAIRFGDADEDAGPAMSRPFGVAVMFGGFDYRGPQLYHMDPSGTFIYFDAKAIGSGSEGAQQRLQELYHKGMSLKEATHMILTILKEVMEEKLTDNNVEIAVVTAEEKQFRMYTKEEVSKVIGETQAQTS

SEQ ID NO: 12291 - protein, 388 aa, Nezara viridula
MSEYWLISAPGDKTCQQTWETMNNLTSKQHNLSENFKFHIPDLKVGTLDQLVGLSDDLGKLDNFVDQVTHKVAQYLGEVLEDQKDKLQENLMANNTDLSTYITKFQWDMAKYPIKQSLRNIADIISKQVNQIDADLKTKSTAYNNLKSSLQNMEKKQSASLLTRNLADLVKKEHFILDSEYLTTLLVVVPKSNFNEWNTSYEKLTNMIVPRSSQLVYQDSDFGLFTVSLFKKVVNDFKLMAREKKFVVRDFIYNEEELAAGKNEITKLVTDKKKQFGPLVRWLKVNFSECFCAWIHVKALRVFVESVLRYGLPVNFQAMLIHPHKKSVKRLRDLLNQLYAPLDSSAQQQGNQGGGNDSVDIPGLGFGQSDYYPYVYYKINIDMLDTKA

SEQ ID NO: 12292 - protein, 550 aa, Nezara viridula
MSTLGVPLSVGGTRQSGAPVRTQNVMAACSIANIVKSSLGPLGLDKMLVDDIGDVTVTNDGATILRLLEVDHPAARVLVDLAQLQDEEIGDGTTSVVIIAAELLRNADELVKQNIHPTSIISGYRLACKEAQKYIQEHLCVSVEELGKDSIINIAKTSLSSKVIGIDDDFFATMVVEAAQAVKVSDSKGKATYPIKAINILKAHGGSAKESILVNGYALNCMVASMGMTKRVENAKVACLDFSLQKTKMKLGVEVLVEDPNQLEAIRDREADITKDRIQKILSVGTNVVLLSGGIDDIYMKYFIEANAMVVRRVKKADLKRIAKATGASFATSLTNMEGEESFDASLLGEAAEVSQERICDDELILVKGPKAHSAASIILRGPNDYFCDEMERSIHDSLCAVKRVLESKTVVAGGGAVEAALSIYLENFATSLSSREQLAIAEYAKSLLVIPKILAVNAALDSTDLVAKLRAYHNTSQTKKDHAHLKWHGLDLYGGAVRDNKKAGVLEPTISKIKSLKFATEAAITILRIDDLIRLEAEKKDHQGHGDMN

SEQ ID NO: 12293 - protein, 258 aa, Nezara viridula
MLNISDAMTSFERNSIRSNDSTLEDHQVKIIKAPDFLTRTLYPMTTTASVVGIKFNNGVAIAADVGGYYGSLNRFKSLDRLYKVNNNIVMTTTGDYADFQYMRELIQQKVISEEILDDSFSLKAFSLHTWLTRLMYNRRSKFDPLWNNVIVAGYDNNGPFLGIVDKLGMSYEDSCVATGMGGYLATPLLRDVFERGKGNLTKQEAHAALQKCMEILYYRDTQSLPKFRIATVTEEGVEISPELEVEGNWEIVKHSKGF

SEQ ID NO: 12294 - protein, 683 aa, Nezara viridula
MNDHLKKFSGVDFNPDKYVKEISQVCVGGIELQSHRAKIQALAEETSQNLKKNVYKNYMQFIETAREISHLEGEMYQLSHLLSEQRALLGSMSNSGAEPVLQASSKAQEEKRIAALSSVLEIIESCPDLLDTPGRELLHEGDIVELDPLENTALHRTRALLFSDMFLIATWISERKGQAKYKFESSYDLGSMAVVNVRDLGQVKHAFKLLVFPDTRLFQCVNNEAREEWLKRFDEAKKARLNSEQIKKKDDNVKEPHTIHEQLAKPPERTDSVEFGSNPFGFVLDDDEDCNALPEWLTEAADDLDVSIAQRHFEEAYAIIQKAEEYFASAQDDQSLTDIKSKVENRKDVLISVLLSELNVSAEKSLQGGLRASRRAVRLLNQLNKSTQACELYLKVCTNLLKAQSKRVKREGATVAYVKRLSEVYFSNLASITSEFQYRAFPHNQDCTSAFVVWVSMEASHFLSHIIKQVFIPQTPLGTLAECIDIIRKQSQQMCELGLDLSYQVNGQTMTAVTRAVAEAGEKAVDAVKVRAAEDPWRPSRQTQQSVNKIQSELGLPVSEYLAQDGVFELTANSLSFAKLLSSLTDEGLMISCQDLEFALSKVLKEVLKAHLNHLSASYSSNKFGSQRSLIQQNAKFILDQLLESVQRKYSEKMGHRCKKLDTLRKEFNFILKESKTTITGYI

SEQ ID NO: 12295 - protein, 1259 aa, Nezara viridula
MDEVKKLEHLSLVSKICTELENHLGLNDKDLAEFIIDLASKNNTFESFKKALLDNDAEFSDSFISNLLRIIQHMRPKSELTVTKDMTKQEKLSMKFPGLAIPNDVQPMKSHNEKKLNLSTIKEDPEDNEVEDAMAALEALAPSKEMKFNYKTERASKSPEKIIKQELEKPRKRSRSRSRNRDKKRNRSRSRSRGRGRSKEKTSSKSRQRSVSRGRRRRSRDRSSSRNRNHVKNRDRERRDKNDRRSRSRSNGRKRNERSRSRSTGRRRNDRSRSRSYDRKKNDRKRENEDEKNKNDEPLEPEVGKIYNGKVTNIVSFGCFVQIEGLKRRWEGLVHISQLRREGRVTSASDVVSRGMKVMIKVLSVAGQKVSLSMKDVDQETGKDLNPTVRHAANKDREEEASMRNPDRPTTLLDLGSFDDHDDFQSRKRVNRISSPEKWEIKQMLSASCIDKSELPDFDEETGLLPKEAAEEEDIEIEIVEEEPPFLQGHGRNLHDLSPVRIVKNPDGSLAQAAMMQSALAKERREQKMLNREQEMDQVPTGLNKNWIDPLPESDGRTLAANMRGIGLTNQDLPEWKKHVIGGKKSSFGMKTNMTLLEQRQSLPIYKLKEELIKAVTDNQILIVIGETGSGKTTQMTQYLAEAGFTSRGKIGCTQPRRVAAMSVAKRVAEEFGCRLGQEVGYTIRFEDCTSPETVIKYMTDGMLLRECLVDLDLKSYSVIMLDEAHERTIHTDVLFGLLKQAVQKRSELKLIVTSATLDAVKFSQYFFEAPIFTIPGRTFPVEVLYTKEPETDYLDASLITVMQIHLREPPGDILLFLTGQEEIDTACEILYERMKSLGPDVPELIILPVYSALPSEMQTRIFEAAPPGSRKVVIATNIAETSLTIHGIFYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLSKMLIMSVHLQCSDEILTVVSMLSVQNVFYRPKDKQALADQKKAKFNQAEGDHLTLLAVYNSWKNNKFSNAWCYENFVQIRTLKRAQDVRKQLLGIMDRHKLDVVSAGKNTVRVQKAVCSGFFRNAAKKDPQEGYRTLVDSQVVYIHPSSALFNRQPEWVIYHELVQTTKEYMREVTTIDPKWLVEFAPAFFKFSDPTKLSKFKKNQRLEPLYNKYEEPNAWRISRVRRRRN

SEQ ID NO: 12296 - protein, 414 aa, Nezara viridula
MAPTRKSEGLLARVNFPLYTLQMLTSRHVLVGGGGGSAKTGVANGFEIFELSYDGTRFSAEEVIRHETGPKVVMNSACFSDKKSTFLVAGQESHCQLYRVGISVEKEVSEESMNGTSDPPNLRHRKTSKNHQNGISEVTNNVKKKLVFKFNSGDSIQSDFSEKEPCQRVVTISRCGGWMATGGTDGIVRIWSFPGLRMIRALKAHTKELDDLHFSPDSKQVASVAKDGQAIIWELKSGKQVHKLDWTHPTGIKYLFKRCRFGVVEGKGCRLFTTANPVAGGKEAQGWIHAWDDGRISKSTAVSEPTSALAVRDDGVFIAIGTMFTGSVSIYIAFSLQRVLHVEGAHSMFVTGVELLPCSSAWGAIEAAALSISVDNRVCIHSLPFRKTLPPWLVIIIILFTLLFTFVLCSFIGL

SEQ ID NO: 12297 - protein, 416 aa, Nezara viridula
MAGAMLFERTVSSRDRDNSRILPTSSRNVDEENEEDIKNKEQGILQLGEQYKKEGKAKELAELIKASRPFLSQISKAKAAKLVRSLVDYFLDLEAGIGIEVQLCKECIEWAKDEHRTFLRQSLEARLIALYFDTGMFTEALQLGSSLLKELKKLDDKNLLVEVLLLESKTYHALSNLSKARAALTSARTTANSIYCPPKMQAALDLQSGILHAADEQDFKTAYSYFYEAFEGYDSVESPKALVALKYMLLSKIMLNTPEDVQQLVSGKLALKHAGKDIDAMKSVAQASHKRSLADFQLTLKNYKKELEEDPIVRAHLGTLYDNMLEQNLCRIIEPYSRAQVDFISKSIKLPLPQVEKKLSQMILDKKFNGILDQGEGVLIVFEDAIVEKTYEMALEVINSMGKVVDTLYQKAKKLS

SEQ ID NO: 12298 - protein, 561 aa, Nezara viridula
MSTKSPKKTTPAGASSAGPSRSSPRKSETPTPQGARKSPLSPTRYSRLHEKQELANLNDRLACYIDRVRNLETENNRLTREVKSSQENITREVTSVKSLYESELSEARKLLDELSREKTKLQIDTRRLYTENEELKTELEKKTKDCNILQTSLSVSENRLADLTTKYNQLQGERKKLADENKALENERNKLSIQLSDTRKHLEEETLQRVDLENAVQTLREDFSFKEQLHEQQLLETRTKKQVEISELDGRLTQEYEERLYQSLQEIRDQYECDIENNKEEIKKLYEEKIRSLGSQLTRNSNAAAMAIEEMKNMQAKLNELNRKLLDLEADRNAAQQKARDLEKILEQAKAQYMEEYSQREAEITTLREEMAHQVQEYQDLMDIKVALDLEIAAYRKLLEGEEARLNITPVSSPAQTSSRKFLGRKRKRTFIEESDETDLSNYSVTSSSKCDVAISEVCSEGQFIKLLNKSTKEVSLGGWQLTRKAGDSSTIYKFHRNIKMEPGATITVWSSDVPDKSHEPPESLLMKGQRWMVADTMTTVLLNPAGEEMAISEHKKTTTE

SEQ ID NO: 12299 - protein, 802 aa, Nezara viridula
MADMKSNEDLSTAILKKKDRPNRLIVEDAVNDDNSVVALSQAKMDELQLFRGDTVQLKGKRRKETVCIVLSDDTCPDEKIRMNRVVRNNLRVRLSDIVSIQACPEVKYGKRIHVLPIDDTVEGLTGNLFEVFLKPYFLEAYRPIHKDDTFVVRGGMRAVEFKVVETDPAPYCIVAPDTIIHCEGTHIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEQAEKHAPSIIFIDELDAIAPKRDKTHGEVERRIVSQLLTLMDGLKQNSHIIVMAATNRPNSIDAALRRFGRFDREIDIGIPDTTGRLEVLRIHTKNMKLADDVNLEQIAAETHGHVGADLASLCSEAALQQIREKMDLIDLEEDQIDAEVLNSLAVTMDNFRYAMGKSSPSALRETVVEVPNITWDDIGGLDNVKKELQELVQYPVEHPEKFLKFGMQPSRGVLFYGPPGCGKTLLAKAIANECQANFISVKGPELLTMWFGESEANVRDIFDKARAAAPCVLFFDELDSIAKSRGGSVGDAGGAADRVINQILTEMDGMGAKKNVFIIGATNRPDIIDPAILRPGRLDQLIYIPLPDEKSREAIFRANLRKSPVAKDVDLQYIAKVTFGYSGADLTEVCQRACKLAIRQSIEAEIKREKSRLDGATRMDMDDEDPVPEITREHFEEAMRFARRSVTDNDIRKYEMFAQTLQQSRGFGTNFRFPASSNIPSAPGGGGTETNNFPDDGDDDLYN

SEQ ID NO: 12300 - protein, 277 aa, Nezara viridula
MTDQQMDCALDLMRRLPPQEIEKNLSDLIDLVPSLCEELLSSVDQPLKIAIDKGVGKDYLLCDYNRDGDSYRSPWSNTYDPPLEDGSMPSERLRKLEVEANAAFDQYREMYFEGGVSSVYLWDLDMTGFAGAILIKKAGDGSKKIKGCWDSIHVVEVQEKTTGRNAHYKLTSTVMLWLQTNKTGSGTMNLGGSLTRQMEQDAPVSEASPHIANIGRMVEDMENKIRNILNDIYFGKTKDIVNGLRSTQALSEQKAQAALRQDLAVALQKRQAKTAEN

SEQ ID NO: 12301 - protein, 1163 aa, Nezara viridula
MQQMDSLQPNNATGLVKTGLEAGAGSGMKEPPPREEPVLDPINGVVQPPVIPPSHRPGRVTNQLQYIQKNVLKAVWKHQYAWPLQQPVDANKLNLPDYHKVIKHPMDLGTIKKRLENNYYWCGAECIQDFNTMFNNCYVYNKPGEDVVVMAQTLEKLYLQKLETMPKEEIELEPPPPKGSKPVKKRPGVIGPGRGGGTTGAGRGRPSNSTTAAAAVVAAPVPPATPPSHLPATIPGSTATTTVPTTHHNSLPPQVGQPAAVPSNFNATTVDPLLTPGLAPGVGPKGGKGAVVQTPTAPKPKKGVKRKADLANDSPAGFDPTYTPGDSKAAKVGTRRESGRQIKKPQRQSDDGMPFSQSPMAPYSHSNSTQASHEKPKEKLSETLKACNEILKELFSKKHFNYAWPFYKPVDAEWLGLHDYHDIIKKPMDLGTVKQKMDNREYKTATEFAADVRLIFTNCYKYNPPDHDVVAMGRKLQDVFEVRFAQVPEDSPTSTVPEKEDESTSGSSSGSESETDNSEDERARKLSQLQEQLRIMQEEMRKLVEEGTVKKKKKKKDGSGSGGSSSSKKRKSADRTLGKAVDGGLLAGVGAPAIMEMKATDGVKAVPPPGRNAVPSPQVKPNKGKAPGRTPGKTNSQGKRPKPNSRSTNSKKKNPVVTSEFNSEDEDNAKPMSYDEKRQLSLDINKLPGDKLGRVVHIIQAREPSLRDSNPDEIEIDFETLKPSTLRELESYVASCLRKKPHKKVSAKSKDEAMAEKKQELEKRLQDVTGQLGGSAKKQAKKQGQGRLSASSSSSSDSDTSSSSLSSSSSDSSDSEAGKAGRPPRKKNKKNHQLATTAASAVQQNQTVPSLTMTTATGTIVNKSVGATQPVVPLASTNKLTVPTVSAVAHPEPVKPVVASHSSLPQQPARPTATAAPLTTAKRASIPTPATALGIPPPAPTSLETGPVEIKQELDVPVSLAPVPDHLDFKNLLEVKPELNDIVTGMPSVFDPLPDSPPIIKEEKHAILPHHADGHLNNSLPPISNIPVQPIIPSAALPTTPHVLDMNKNSQPPQLPQTPVLPHSFKPKTVEQNLKNASSWSSLAQSPTPALTPTPPTAAALKSSMADSFQAFKKQAKENAKKRALIEQQEMRRHQKEQAERERLRVENEKRREREEEEALEKA

SEQ ID NO: 12302 - protein, 427 aa, Nezara viridula
MIPPSSRPQVTVYSDKNEPTGELLTLPAVFNAPIRPDVVNFVHQNIAKNHRQPYAVSAEAGHQTSAESWGTGRAVARIPRVRGGGTHRSGQGAFGNMCRGGRMFAPTRVWRRWHRKVNVNQKRYAMVSAIAATGVPALVMSKGHMVNEVPEIPLVVTDKIQEYTKTKQATIFLHRIKAWTDIQKVYKSKRFRAGKGKMRNRRRIQRRGPLIIYGQDQGLTRAFRNIPGVDLINVSRLNLLKLAPGGHVGRFVIWTQSAFDQLNALYGTWKKKSTLKKDYNLPMPKMVNTDLSRLFKSEEIKSVLKPPRKTIVRRVRKLNPLRNTRAMLKLNPFAAVLKRKAILADRKLKLERAIERSKKEGVELTPHQKRYVAMLERRKAQIKAAKAAKPKKVKKPKAEKAAADEAKKAAVTKKPAKKAAAPKPPKK

SEQ ID NO: 12303 - protein, 1822 aa, Nezara viridula
MADFIDSEAEESEDEEELEVHEKKKLKRLKAMESDEDEEEEDDEERLREELKDLIDDNPIEEESESDGSGSEEGSGEDRGGEKRKKHDEDFDDRLEDEDYDLLEENLGRKVERRKRFKRLRRIEDEESDGERVEDEGEVREAIANELFEGSDHEPEDREEDRSSSRGPAPERYEDEEEDGEYSDADDFIVDDEGRPIADKRKKRKPIFTDAALQEAQDIFGVDFDYEDFERLGEDEYEEEEDEDEYVDEEGIEDSERRRKPTKKAARKKPTRKSIFEIYEPSELKRGHFTDFDNKVRNTDIPERMQLREIPVTPVPEGSDELSEEAEWIYKQAFCKPTTSNQEWGNTMERGKPKKEPQTVEKIKKALDFMRNQNFEVPFIAFYRKEYVLPELNINDLWRVFKYDAKWCQLRSRKMTLLSLMEKMRDYQAEQLMKDIDAPIPDHVRVIKDDDIERLKAVQTTEELKDVHSHFLMYYADEVKIMLEATRIKEREAAKAKARQEKQLDENGDPIETEVEEQEEPLPPEIPSVKHSIRSGPYAICRKAGIGGLAKRFGLKPEQFAENLRDNYQRHDVEQEPSLPLELAKEFVSSKFQAPEDVLKAAKFMVATQLSREPLVRRCMRDTFFEKAKIDVKPTKKGSKEVDENHPCYVMKYVKGKPVRDLTADQYLKLHIAHQDKLLNVSISDHIGGHTTTSYIEEIKQLYYRDEFMQHVQEWNNIRQECVDVAIKKMLVPELIKELHTRLLEEAKEFVLRSCARKVYNWIKVAPFNVEFGDDDEDDWDTSKGIRVMGIAYVPDLAQASFACMVAPDGECTDFLRLPYLLKRKNTWREDERMQKESDLALIRNFILTKKPHAVVIGGESRDALMVAADLREIISNLVEDEQFPQIPVEIMDNDLAKVYANSLKGESDFRDYPMLLRQAVSLARRLQDPLVEFSQLCTPDDEILCLRFHPLQEQLSKEELLDVVTLEFVNRTNEVGVDINEVVANPICGNLVQFVCGLGPRKGTTLIKILKQTNQRLENRTQLVTTCHMGPKVFINCAGFIKIDTNALGDSTEAYVEVLDGSRVHPETYEWARKMAVDALEYDDEDANPAGALEEILEKPEKLKDLDLDAFAEELERQSFGNKSITLYDIRSELNHRYKDLRVAYQSPGPELMFDMLTKETPETFYIGKLVTATVIGISHRKPEKDQLDQANPVRNDETGLWQCPFCLKNDFPELSEVWNHFDAGGCPGQATGVRIRLDNGITGYIHIKNLSDKHVTDPAQRVTRGQMIHCRVTKIEVERFSIEATSKSSDLLDKNHDWRPQKDPYYDHENEKKDLHTEEEAKKNRQKLTYIKRVIVHPAFHNISYIEAEKIMATMEQGDVIVRPSSKGADHLTVTWKVADGIYQHIDVREEGKENAFSLGQSLWIGNEEFEDLDEIIARHVNPMAAYVRDMFAFKYLKDTEGGLKDKAEEYLKEEKKKNPAKIHYIVSVSKNYPGKFLLSYLPRARCKHEYISITPNGFRFRGQFFESVNSLFKWFKEHFSDPIPGTPSTPRSAMSARTPYTNTPGPMPINMNAEAIQRVAQNMPNHMLHSLSQVASHTPHYPHTPGAYSLHQYPATPYTPSGQTPFMTPYTTPRYGSGMTPGHQSIMSSGSITSPQSSTPGQPVFLHPGSITPSHRTPVANFHRPGGTHPEDWGKKAEEWVAKKRENASRTPRSTPNSGTPRHGTPRDDANKNRTPRYADNDFTSPRPGANFTSPRYSNWNKVAGTPNSHISAYEDANYDARSLKSPRPPPAQGKYDPYELGQGKSPRYSLTPRSTPRTINSPRSMSLGDSTPLYDESI

SEQ ID NO: 12304 - protein, 759 aa, Nezara viridula
MEEPKERKNCRKHRRNSDKTEYKSKSDKELSGRESKRRRNYDYDKSSNHSSGERRYDSEHRRYEKLKRYWDKDTGKDRHDKDVKADYLVGSRYYNETPKHSLIKSSEGPTKSKENVNPLESTRKENQVTRKKNDDIITSRTGGAYIPPGKLKLMQASITDKSSAEYQRIAWEALKKSIHGHINKVNTSNIGVVARLLFKENIIRGRGLLCRSIIQAQSASITFTNVYACLVAIINSKFPNIGELLLKRVIIRFKRAYKRNDKAVCISSATFIAHLINQGVAHEILGLELVTLLVENPTDDSIEVAVAFLKEAGQKLSEVTSKGTNAIFDMLRNILHEGKLEKRVQYMIEVMFQVRKDDFATFPAVPEELDLVDEENQFTHLIGLDDAIDTQDILNVFKLDSEYQANEERYKELRSEILDTDSEDSGSEGSSTEAEEDSDSEDEEKKVTIVDNTETNLISLRKTIYLTIQSSLDFEECAHKLLKMEIKPGQEKELCHMFLDCCAEQRTYEKFFGLLAQRFCQVNNTYIAPFEQIFADTYSTVHRLDTNRLRNVAKLFAHLLFTDAISWAVLSNIRLNEEDTTSSSRIFIKILFQELSEYMGLVNLNARLKDPTLQSAMEGLFPRDNPKNTRFAINFFTSIGLGGLTDELREHLKNLPKSIPVSQLIQELSSESSTSSSSESSSETESTSSSDSSEDERSKKKKKKKRPNASKEIPNKKREKNQGNFQENNRSTKETKKKSYYKTKHEREEKHHPRKSKKK

SEQ ID NO: 12305 - protein, 574 aa, Nezara viridula
MNEAIRQKKKAKEVEWRVLVVDQLAMRMISACCKMHEISAEGLTIVEDINKKREPLPTMEAVYLITPSEKSVHSLMNDFASPNRIMYKAAHVYFTEACPNPLFDTLCHARVSRFIKTLKEINIAFIPYEQQVFSLDAPETFQCFYNPSLSNSRLANMERIAEQIATLCATLGEYPSVRYRSDFDKNVELAQIVQQKLDAYKADEPTMGEGPEKSRSQLLILDRGFDAVSPLLHELTLQAMAYDLLPIENDVYKYEATAGAPEKEVLLDENDELWVELRHQHIAVVSQNVTKNLKKFTESKRMPQGDKQSMRDLSQMIKKMPQYQKELSKYSTHLHLAEDCMNAYQGHVDKLCKVEQDLAMGTDAEGERIKDHMRNIVPILLDQSVSNYDKMRIILLYTLSKNGISEENLNKLVQHAQIQPHEKQAIVNLGNLGLNVVVDGTRIKKPYVPPRKERITEQTYQMSRWTPVIKDLMEDSIDDKLDLKHFPFLAGRAASSGYHAPASVRYGHWHKDKGQQTVKNVPRIIVFIIGGMSFSEIRCAYEVTNAVKNWEVIIGSSHILTPEDFLSNLANLSN

SEQ ID NO: 12306 - protein, 716 aa, Nezara viridula
MMQQYMKELEQDPYSYEDFVERLAWRTVDGFKEDGIHGFDPNLMHETFLQAIKDLQVLQDRQCKKCEKLELICKEEEANHFQDIAHLQDKNKEAFALFQDLDERINFVATKVIHLGDQLESVNVPRSRAVEAQRLMVYFSEFLSPGPVLASVFSNKEEVFEAADIIQKLHMISQELPSDKFKDARSKISLKYDEIERSLIEEFVKSHRVHETTRMKEIANILMHFKSYSQCIDAFIEESQMGTFVGKDIFKEILPLTKKNFSIMREVFSNPEQVMAKFVLNIYHLKLQKHIVSNLSDKSDTNKYLRNLMELYTRTTELSAELSCFKMGSDDSYLQKLTHNIFQKYLESYISVEVKGLKEKCSTLLQKYYDSKDHHKRQIQSGGFQDFRRDLQAVIGTRANINIAQIEDYGGETFLSEELVISLIQESKQAFYRCKLLSKPADLASNAVQLLEVLLNCIIIDHVDYAVELALQAVPIPESKTQSQPIYFFDVVRQANTIVHLIEKHFNDSALPLVMSTSKHGECVMKKKFLLNHLEQKLDSGIDRALNAIVGWVKVFLQSEQKKTDFKPETELNTLSSPACIAVVEYFNDNVKHIRACLDGRNIECVMTELGCRFHRVIYDHLQQFQYNSTGALCVICDMNEYRKCVKELNSCLVNTLFDTLHALCNVLLVKPENLDQVCTGDQLSLLDRSVVLNFIQLRNDYKTQKLSNFLKGMSA

SEQ ID NO: 12307 - protein, 276 aa, Nezara viridula
MDFQNRPGGKTGSGGVASWSETNRDRRERLRQLALETIDINKDPYFMKNHLGSYECKLCLTLHNNEGSYLAHTQGKKHQANLARRAAKEAKDSPQQPAPDKPRIEPKKFVKIGRPGYRVTKQRDPETGQQSLLYQVDYPEIAEGILPRHRFMSAYEQRVEPPDRKWQYLLFAAEPYETIAFKVPSREVDKSENKFWTHWNKDTKQFFLQFAFKNEPLAPPMGAPHLGQMRPPHMLPPPMSVPPPPMFNPVPPPPPNLMLAPPPPPAPLPPPPQPMK

SEQ ID NO: 12308 - protein, 134 aa, Nezara viridula
MSIGVPIKVLHEAEGHIVTCETKTGEVYRGKLIEAEDNMNCQMTGLTVTYRDGRVAQLENVFIRGSKIRFLILPDMLKNAPMFKKQGNKGNTGAGRGKSAILRAQAARGRGSQSRGGATSSRPSWQSGSNQSRK

SEQ ID NO: 12309 - protein, 440 aa, Nezara viridula
MASSVSKVPLLQTLAKRTFAAVAAPKAAGSQNKVEVTTLPNKAIVTSLGCGPKPIVQVAVAFRAGSRNETSENYGASHILRSSAGLSTCNASSFYICRSLQQIGASLTATSDRETIVYVLESSASNINEGLDTLRKAVTGQEFRPWELSDNISRIKIELASLPSQAKVIDLIHKAAFRSGLGNSIFVREFNIKKLNSETLQHYAANNLTGDKAAIAGCGISQSDLTCFAESLGLCPGSGSALPASKYSGGEIRIEENIPLQHTIIAAEAPSLDKSDALAYAVLRYALGTGPSVYRGTGSGPLSKVAGVLVGAQALSMAHSDAGLFGIYVASPGYNAKEAVEAAVKVLKGGVTDQDVARGKAQLKAALLYSNERCRGLVDDLVGQALLVTGVPPKSAAELADQVSSVTTQQVQQALQKIQSGKKSLATIGSISKVPYLDEL

SEQ ID NO: 12310 - protein, 112 aa, Nezara viridula
MRRAHGNYYQPVPTFDGPSGSLEEENDQMTNKLKDKITALKHLSIDIGAEVKYQDKMLHGMSEDFDRTGGFLGNTMNRVLRLTKGSHNYYILYLFIFSIVVFFVLYIILKFR

SEQ ID NO: 12311 - protein, 462 aa, Nezara viridula
NGPLVILDEVKFPKYNEIVQLRLADGTLRSGQVLEVSGSKAVVQVFEGTSGIDAKNTICEFTGDILRTPVSEDMLGRVFNGSGKPIDKGPPILAEDYLDIQGQPINPWSRIYPEEMIQTGISAIDVMNSIARGQKIPIFSAAGLPHNEIAAQICRQAGLVKSPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHSDVSNQLYACYAIGKDVQAMKAVVGEEALTPDDLLYLEFLTKFEKNFISQGTYENRTVFESLDIGWQLLRIFPKEMLKRIPASTLAEFYPRDSRHTTTK

SEQ ID NO: 12312 - protein, 742 aa, Nezara viridula
MMQQAQSRPMSHGNYQGGPDLPMGSVKDQTLMWQQSSYLADSGIHSGATTTAPSLSGKEEEMYGDQDMFDLDQGFTQGFTQEQVDEMNQQLSQTRSQRVRAAMFPETLEEGIEIPSTQFDQAQATAVQRLSEPSQMLKHAVVNLINYQDDADLATRAIPELIKLLNDEDQVVVSQAAMMVHQLSKKEASRHAIMNSPQMVEALVRALSNSNDLETTKGAVGTLHNLSHHRQGLLAIFKSGGIPALVKLLSSPVESVLFYAITTLHNLLLHQEGSKTAVRVAGGLQKMVVLLQRNNVKFLAIVTDCLQILAYGNQESKLIILASQGPIELVRIMRSYDYEKLLWTTSRVLKVLSVCSSNKPAIVEAGGLPALAVHLGHPSQRLVQNCLWTLRNLSDAGTKVGGLEGLLQSLVQLLDSSDINIVTCAAGILSNLTCNNQRNKVTVCQVGGVDALVRTIISAGDREEITEPAVCALRHLTSRHMESELAQNAVRLNYGLQVIVKLLHPPSRWPLVKAVIGLIRNLALCQANHTPLRDHGAIHHLIRLLMQAFQDTQRRSSVTSGGTQSGGIYADGVRMEEIVEGTVGALHILARESHNRAIIRGQMVIPIFVQLLFDEIENIQRVAAGVLCELAQDKEGAELIEQEGATAPLTELLHSRNEGVATYAAAVLFRMSEDKPQDYKKRLSMELTNSLFREDQNLWNGDLGMAPDLQDMLGEQNYDTMYSHGPPSVHSSHGGRGYQPGL

SEQ ID NO: 12313 - protein, 277 aa, Nezara viridula
MARNAEKAMTTLARWRAAQLGEGDQAKQRRPYLASECTDLQQAEKWRMQIIREIARKVSQIQNAGLGEFRIRDLNDEINKLLREKGHWEAQIRELGGPDHSRSGPKMLDAEGKEVPGNRGYKYFGAARQLPGVRELFEQAPPPPPHKTRGELMRDIDASYYGYMDDEDGIIIPLEEIEETKAIKKAVAEWTVKKEKSMEIDEEEKEEVEEDNIYKAAGNKEGGEDDEEEDAGEDDGFELSAKLLEGYRAHIPVPSQREVEAAILERKKQELLERYAL

SEQ ID NO: 12314 - protein, 214 aa, Nezara viridula
MEEADVPSFKCVLVGDGGTGKTTFVKRHLTGEFEKKYVATLGVEVHPLVFHTNRGPIRFNVWDTAGQEKFGGLRDGYYIQGQCAIIMFDVTSRVTYKSVPNWHRDLVRVCENIPIVLCGNKVDIKDRKVKAKSIVFHRKKNLQYYDISAKSNYNFEKPFLWLARKLIGDPNLEFVAMPALLPPEVNMDPEWKDQIERDLQEAQDTALPEDDEDL

SEQ ID NO: 12315 - protein, 159 aa, Nezara viridula
MDIQTIATIFIKVLKLVINFIILMLYRYGGKQGFLGVGGTWNLYEVKSADAEIIASGVFVGFFIYTSVILISYCFGTTKHKYSAVDIIMNVSGTILFTAVGGIALHYWVGFQDENHYVGISQEKQIGLALGSLSVVCAAIYLLDTVLSCIHIAHKHAIA

SEQ ID NO: 12316 - protein, 778 aa, Nezara viridula
MPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEEGEDGADDPRKLKPGEIDPNPETKPARPDPKDMDEDELEMLSEARARLANTQGKKAKRKAREKQLEEARRLAALQKRRELRAAGIEYAARHKRKRGIDYNAEVPFEKKPAPGFYDTSNEAIDPHAPNFNRLRQQNLDGELRSEKEERERRKDKQKIKQRKENDMPLAMLQNQEPAKKRSKLVLPQPQISDQELQQVVKLGRASYAAREAVTEGSESASDTLLNDYALATPNAGSTPRTPAPTTDRILQEAQNMMALSHVDTPLKGGLNTPLYNSEFSVHPPSDQITTPNTVLTTPFSNRTHEGRTPGFQTPQDVRTSLTTPVRDKLNINPEEGGDTPYAPVNNQKQVKEELAARLRSLPQPKNDYEIVVPEDEVSSETAAEGSGMLSVEDQADIDARNLSFLAQQREKELKSRSQVIQRALPRPGDINIVLRPANTDPPLTDLQKAEEMIKEEMITMLHYDAIHSGEPSSARKIGTVSQAQHLAYLEQHPYHTYSEDQIEKAKEMLKAEMEVVKQGMNHGDLSLETFTQVWEECLAQVLYLPNQNRYTRANLASKKDRLESVEKRLEQNRTHMTREAKRAAKMERKIKIITGGYQTRAQALIKQLQDLADETDKAHMELSTFKLLQQQEENAIPKRIESISEDVNRQLEREKSLQKRFSQLQLVSQS

SEQ ID NO: 12317 - protein, 157 aa, Nezara viridula
MMQFMLLFSRQGKLRLQKWYVAHPDKLKKKITRELITTILARKPKMCSFLEWKDLKIVYKRYASLYFCCAIEQNDNELLTLEVIHRYVELLDKYFGSVCELDIIFNFEKAYFILDELLLGGEIQETSKKNVLKAIAAQDLLQEEETPQGFFEDHGLG

SEQ ID NO: 12318 - protein, 437 aa, Nezara viridula
MSYSIILSRLSRFPLFSYSRGYSVITSQNVKNIPVSFRYYSSGGRRPNFFSQFIENVRQDLAKSKEMKESLKKFREEAQKLEQSEALQKARAKFQTVESEASKGGEVFKEKLDHIKDKVSDVLEEAAKSEIGKKAGQLGAEIGKTARGAAETLSETGQQIGKSGAFQTISQTAAAVKQELDQSGIHAHVYQPPRKLRKRLEIVPDNKALKPDTETLGIDLHKDSKFFQSWQQFKDNNAYINKVLDWKMKYDESDNPVIRASRVFTDKVSSVMGGLFQKTELSETLTEICRIDPNFDRAHFLKDCEKDIIPNILEAMVRGDLDILQDWCHEGPYNVLAAPIKHAKEAHFKFCSKILDIDNVDLVMGKVMDQGPVLVISFQSQQLLCIKDKNGNIVEGDPNKVLRVNYVWVLCRDPSELDPKAAWRLLDMSAQSNEQLL

SEQ ID NO: 12319 - protein, 253 aa, Nezara viridula
MKRPTLRELELQELENYEGETDSETEAIQEAFARGDLKPGLNIPVKDKVKTNNVPLLKDTLSEIKLDLPWIERLDVTNEQAPLAPELALQIREEEQGHNPLVYDELKRESVFYRQAQNAAMKVLPKLKELGLRTERPDDYFAEMAKSDQHMQKVKGEAIKKKLMMERIEKLREIRAQKKVQKALHAQAKVAKVQSKKQMLEEVKKYRKGETKSLAFLEPGFKPKAKPNKSQIKRQRKDTKFGHGGKKRGAKRN

SEQ ID NO: 12320 - protein, 1259 aa, Nezara viridula; identical to SEQ ID NO: 12295

SEQ ID NO: 12321 - protein, 665 aa, Nezara viridula
MNTGPGGPNYPMASLYVGDLHSDVTEAMLFEKFSSAGPVLSIRVCRDMITRRSLGYAYVNFQQPADAERALDTMNFDNLKGRPIRIMWSQRDPSLRKSGVGNVFIKNLDKSIDNKAMYDTFSAFGNILSCKVAQDENGVSKGYGFVHFETEEAATKSIDKVNGMLLNGKKVFVGKFIPRKEREKELGEKAKLFTNVYVKNFGEDFTDDMLKEMFEKYGPITSHTVVVNKDGKSRGFGFVAFEDPEAAERAVEDLNGKELIEGKPLYVGRAQKKAERQQELKRKFEQLKMERMNRYQGVNLYVKNLDDTIDDERLRKEFSPFGTITSAKVMLEEGRSKGFGFVCFSSPEEATKAVTEMNGRIVGTKPLYVALAQRKEDRKAHLASQYMQRMANMRMQQMGQIFPTGGTGGYFVPTLPQPQRFFGPAQMAQMRPQPRWPAQPQVRPSTQAAASGFPNMQGPFRSGPRGPGAAGGGGGPGSAAAAAAAMRSSISAAAAAVAAAGRPTANAAAAAAAAAANPAVARQLAQGGSQGAPVSVSAQGRPANYKYTANMRNPPPMGGGAGAGAGGPPQQALHIQGQEPLTASMLSSANPQEQKQMLGERLFPLIRSMYPDLAGKITGMLLEIDNSELLHMLEHHESLKAKVEEAVAVLQAHQAKQAAASVKKE

SEQ ID NO: 12322 - protein, 912 aa, Nezara viridula
MTDSKYFTTTKKGEIFELRSELNSDKKEKKREAVKKVIASMTVGKDVSALFPDVVNCMQTDNLELKKLVYLYLMNYAKSQPDMAIMAVNTFVKDCEDANPLIRALAVRTMGCIRVDKITEYLCEPLRKCLKDEDPYVRKTAAVCVAKLYDINPQLVEDQGFLDQLKELLSDSNPMVVANAVAALSEMNEASVNGAPLIEMSAATINKLLTALNECTEWGQVFILDSLANYSPKDEREAQSICERITPRLAHANAAVVLSAVKVLMKFLEMLPSESDFVSTLTKKLAPPLVTLLSSEPEVQYVALRNINLIVQKRPDILKHEMKVFFVKYNDPIYVKLEKLDIMIRLASQANIAQVLSELKEYATEVDVDFVRKAVRAIGRCAIKVEQSAERCVSTLLDLIHTKVNYVVQEAIVVIKDIFRKYPNKYESIISTLCENLDTLDEPEARASMIWIVGEYAERIDNADELLESFLEGFHDENTQVQLQLLTAIVKLFLKRPTHTQELVQQVLSLATQDSDNPDLRDRGFIYWRLLSTDPGAAKEVVLAEKPLISEETDLLEPTLLDELICHISSLASVYHKPPTAFVEGRAGLRKSLPARSGSAEVVQETPGAQVIPSQDSLIGDLLSMDIGGVSAPPPPQPTSAPVDLLGLDSLLGGVPEPAVSQSTTGLLGDIFGLGTAGPTAYAPPKTMWLSSDRGKGCEISGTFSRRNGQIQMDMTIVNKAMQPMTSFAIQLNKNSFGVTPARALQVLSPLPPGVSHDCSLPLVTTGAVQRMEPLTNLQVAIKNNIDVFYFACVIPMHVFFTDDGQMDKRVFLATWKDIPAQNEVQYTLTNVQSNADIVVQKMQENNVFTIAKRNVEGQDMLYQSVKLTNGIWVLIELKIQPGNPNITLSLKSRALDIAAGIFQVYDAILHS

SEQ ID NO: 12323 - protein, 165 aa, Nezara viridula
MPPKFDPNEVKTVFLRCVGGEVGATSSLAPKIGPLGLSPKKVGDDIAKATADWKGLKITVCLTIQNRQAAISVVPSAASLIIKALKEPPRDRKKVKGVKHNGNLTFDEILTIARSMRPRSMSRKLEGTIKEILGTCQSVGCTVDGKTPSEVICQINDGEIDVADE

SEQ ID NO: 12324 - protein, 369 aa, Nezara viridula
MCGEEPNIGEMKALILVGGYGTRLRPLTLSRPKPLVEFANKPMLMHQIEALVEAGVTEVVLAVSYRAEQMEKELSDEAKKLGVKLIFSHETEPLGTAGPLALAKDILSSTNEPFFVLNSDIICEFPFKELVSFHKNHGKEGTIVVTKVEEPSKYGVVVYDEKGCIASFIEKPQEFVSNKINAGMYILNPSVLKRIKLEPTSIEKEVFPFMAEAGELYAMELSGFWMDVGQPQDFLTGMCLYLTSLRQKAPEKLYAGPGCIGNVLVHPTARIGSGCSIGPNVTLGPGVVVEDGVCIKRCTILENAIIKSHSWLSGCIVGWKSVVGQWVRMENTTVLGENVNIKDELYVNGGQVLPHKSIAKSVQDPQIIM

SEQ ID NO: 12325 - protein, 287 aa, Nezara viridula
MTLDGEETISDQEKVRIVSNFILHSPPGEFNEVFNDARILLNNDTLLKEGALGVFGQYCKDQLTPVKIKNSEYPVLITEHNDLGSNRFYDARSKQSFKYDPLRRETSNYDSWEAEPGTEKWRSALESELDAYIAKHFESGSGSVFSKREDGKVNLVACIEAHLFQPKNCWNGCWRSQWFVTIDSDNADVKGVLKIQVHYYEDGNVQLVSLKDINQTLPVVDEEQLSKALIKIFEDSETEYQQAISENYHTMSDTTFKALRRQLPVTRSKIDWNKMVSYSIAKELKPQ

SEQ ID NO: 12326 - protein, 1185 aa, Nezara viridula
MMEVASSLLLLLLVAFVASKDVSKVSENLVRPYGKNYFTSRRVIGSNFLPNVDDDRMAPSTEEPRIPYVITEDRLKKIRSNFMYWFFDQDSNDGYGDLQKDITPSITQVNKNLNFQLPFFGFRFNYTRVSLNGYLEFSDPPEQYSYPLNFPSVDWPRKNDPAFIGIFYSKCRIGQLGINDVDQREPGVYFRMERDLMTRKDKFGVEMRERVKWDIRESVVGSDSFEPKHAVIVTWKNVSFAGGIENSVQTTNTFQLVLATDEVFTYAIFNYAQIKWTTHTEARGDTVKGEGGVPAYIGFNAGNGTRSYEYRPYSQTSTIRDLVGRGWANGFPGRHIFRIDENILPGTCNKDIAAASLPLAFAPESGNMLGGTIVNITGPCFEPTMKIVCRFDMKAVYGTVVDRNRAICVQPFVMAEGYILFDIAIDDGKYVWKGQYFIETPATAAEKISFADDSVHQKYPPEVRITWNQYNLTSNLAAPVQISIWGYREKSIRPQLLYIDSLDVGVPNNGMYSIIPATYKNRDNHLFTDMSFGFIQINLTTATEYNGLKVTPVIWSKPIPLGWYFAAQWERQLGSNWPEGKCNSWIMNDRYLKNFPAELSICPCKLEHALADKGRFMPDFDCDMDANPHCFYHEGARHCVKTGAPRQEGSEQQCCYDKNNYLMLSYDQQWGSSPKRSSNLGILPWNEPNKVPTLSQWYHDISPFYHCCLWQFEQSVGCETFRFERRPSQDCVGYQSPYIATVFGDPHFITFDGLEYTFNGKGEFVLLHTDSEKFKLDVQARFEQVGKNIYGDVAATQLTSIAARDNTSSIIEVRLRPKEAQWRYRLDVFANKKRIYFDRPSLRVQHFRGVTVYQPSHILNQSEIVIMFQSGVGVEVVENVGYMAARVYLPWEYINRTRGLFGNWSFDPSNDFTLPDGTVASADSLNDLERIHKQFAIHWRLEDNVEPNKGEPLFVREYGRTSSYYLNRTFVPVWKSTPQEIIPPNRTAQIQQALALCGESYQCRYDYAVTLNREMAFYTLNYYSEYTQLRQTNKDRVLSCGVLETPRFGRKSNFFFVPDSKVIFECDQGFILVGDQRRTCSSNGRWSFEYGYTECLLEEEYSLRAFGWTWGIIALVLIPIIIVLVCAGFRIVRRIIEQKKNELHTDQRTQYHPDYTAGPLRYNAREVSLSINPENEPLKKETEVN

SEQ ID NO: 12327 - protein, 113 aa, Nezara viridula
MRYVAAYLLSTLGGKETPSAADIDKILSSVGIESDSERVNKVISELKGKNIEEVIAAGKEKLASVPSGGGGAPAAAAAAPAAASPAKAAEEKKEAKKEESDQSDDDMGFGLFD

SEQ ID NO: 12328 - protein, 911 aa, Nezara viridula
MMTDHIGGITLKWDPKNLEIRTLSVEKTLEPLVLQVTTLVNTKGPSKKKKGRSKRAHVLVAAVEKATENFIEKGEMIAYENPDIKQEMLSAVEEVRKTGEAMSAAAREFADDPCSSIKRGNMVRAARNLLSAVTRLLILADMVDVHLLLKSLRVVEDDLVKVKNASSQPELLENIKAFGRNASELMSQAAKRQLELKDSQLRDDLAAARAVLKKHSTMLLTASKVYVRHPELAAAKANRDYVFKQVCEAVNTISDVAQGKGPSITTNPYEGPGELAAALDDFDERMVMEPLAYSEVATRPSLEERLESIISGAALMADSSCTRDERRERIVAECNAVRQALQDLLSEYMANMSVKEQSEGLERAIDHMCRKTRDLRRQLRKAVVDHVSDSFLETSVPLLVLIEAARAGNEKDVEEYALVFQEHANKLVEVANLACSMSGNEDGVKMVRYAAAQIDALCPQVINAARILGARPKSKVAQENMDVFRDSWESQVRVLTEAVDDITTIDDFLAVSENHILEDVNKCVMALQEGDGDSLDRTAGAIRGRSARVANVVTAEMDNYEPGIYTERVLEAIKVLREQVMPNFAQRVEVAVDALSSNPPKDVDENEFIDASRLVYDGVREIRRAVLMNRSSEDLDTDTEFEPCEDNMTIDTKTRPSAHTDHGVDEYPEISGITTAREAMRKMTEEDKQKIAQQVEYFRTEKLKFDREVAKWDDTGNDIIVLAKHMCMIMMEMTDFTRGRGPLKTTMDVINAAKKISEAGTKLDKLTRQIADQCPESSTKKDLLAYLQRIALYCHQLNITSKVKADVQNISGELIVSGLDSATSLIQAAKNLMNAVVLTVKSSYVASTKYPRQGTVSSPIVVWKMKAPEKKPLVRPEKPEEVKAKVRKGSQKKIQNPIKALSEFQSPAESV

SEQ ID NO: 12329 - protein, 389 aa, Nezara viridula
MNESNLQSTPKTNAATGFFQTTTPKQAGGVSFGSTTMFMPPASSSNTSTPKTTATGNATLFSLSTTTATSAPMASGAVTTSSFPISSSPLTTQQFKQPSTSQPMQLKTTASTAMPLGTGLSSIGGNAPASTGLNFGSTAKSTNAGATLFSATKSALAPVNTAATTSSLTLPPSSTTSLTSSLSNKPVTSTGPSISQQQNLTFQQLEELILNKWTAELYEQEKVFLNQATQINIWDKVINENAEKLTQLHSTMEKVRKQQGKINDDLEIIFTHQKDLEACLVPMEKEDLLSVLKADPNRKNLYINAKKIDSQIKTMSEDLKETIEHINETSRSHDTEDPVIQVGRILNAHMESLRWIDEHTARMQDYFDSLLKMHDDLRRECEISKHDVY

SEQ ID NO: 12330 - protein, 193 aa, Nezara viridula
MFIWDWFTGVLGYLGLWKKSGKLLFLGLDNAGKTTLLHRLKDDRLAQHVPTLHPTSEELSIGNIRFTTFDLGGHTQARRVWKDYFPAVDAIVFLVDACDTTRLPESKAELDALLTDESLINCPVLILGNKIDLPGAASEDDLRNFFNLYGQTTGKSKVPRSELSGRPLELFMCSVLKRQGYGEGFRWLAQYID

SEQ ID NO: 12331 - protein, 596 aa, Nezara viridula
MSGNNVYGEMLLTITSEKFYIEPVQDMDNSLILDRVTGNITISNVPGSSGDAPVVGEKKTIYGILGTIRLLAGQYLVVVTGRTKIGNIWRREVFQMDSAEVICFSRSTTHLNDKQKRIEKEYISMLESILATPYFYFSYSYDLSHTVQRLHNISPDFLKMPMYQRAEQKFVWNEYLLSDFAKNSGVSRFCLPIIHGYLSITSCILNGKTFSLILVSRRSKDRAGTRLFTRGIDSNGNVANFVETEQIVEAKFERASFVQTRGSMPFFWQQYPNLKLKPRPSIIQEENHTAAFSKHFETQLMDYGRQVIVNLVDHSGSEGKLEGFYRKLVNEANNPNLKYEAFDFHRECSKLRYDRLKILIDRLAYDLEQMSVTMIVGDGTVISQQEGVFRTNCIDCLDRTNVVQSLLARANLTYILQRLTILKKGQTVEDQVGLENTFKILWSDHADLISIQYSGTGALKTDYTRTGKRTKSGIIRDGINSLVRYYKNNFQHGFRKDALDLWLGHYRVSSEEGIVIRSPLDVKREFKYTAFPLILLVAIAMFFANLVTPSEYTTGTLLSLIFWCSMVSATLIAIFYNGSEYVDCPRLCPLLRSPSV

SEQ ID NO: 12332 - protein, 454 aa, Nezara viridula
MSPTVPTTTNVDKRPTLVKPHSAERRSELVCRVKYCNTLPDIPFDPKFIQYPFESTRFIQYNPTSLERNYKYEVLTEHDLGVTIDLINKDMYAADHNAVLDPADEKLLEEDILTPHDSKRSRHHSRSVSWLRRTEYISTEQTRFQPQVMDKVEAKVGFSIKKSLKEETLYMDRESQIKAIEKTYDDAKLPIEKHHSKPNVVPIEVLPVFPDFQLWKYPCAQVMFDSDPAPIGKTVPAQLEQMSQAMIRGVMDESGEQFVAYFLPTEPTLEKRRRDFTNGIDYEDEEEYDYKIAREYNWNVKTKASKGYEENYFFVIRHDGVYYNELETRVRLSKRRQKAGTAPNNTRLVVRHRPMDANEFNIHRLREKQLQHPIEEEDEEESAGEEEKKEDEKKTNSKDTDESDKEEGSDKEGGSDKDEGSGKEDGSGKENDSAKENDSGKENDSGKEDGSGKE

SEQ ID NO: 12333 - protein, 341 aa, Nezara viridula
MKLYVHIWQKNNEVRLAELEKEHENSVIEDEEQVSGLWQAKLDYLCSIGDKENASALANSKLQDKTVPKTHRIDAVFALFRISYFHGCDIKGMSAAIEKATELIEGQGDWSSRNKLKAYEGVWSFAVRDYLRAAKLFVDVVPTFESYELADFGTIIKYTVLSCMIALPRCELKKKLMHHGVMAQALHSQYRNLKEYFQSLYDGHYAEFLVALAQVESDMKRDPLLHPHYRHYVQEMRLRAYKQILQAYRSLSLDYMAEAFGVSCEFIEREVAKFAASGRLQCKIDSVARSVITSVHLSDEALRVKDSSDLDLDRSLLYKTTVKRGDILLNRLKKLARVMDF

SEQ ID NO: 12334 - protein, 3748 aa, Nezara viridula
WQCIDCRVCQLCRENEETGRMLVCDYCDKAYHPHCVRPAMSSVPKVGWKCKRCRLCSDCGARTPGGGLSSRWHSNYTVCDSCYQQRNKGFSCPVCHKAYRAAALREMVKCSQCRRFVHGTCDKEADFVSYHRKKEAHPDYQYICLSCKNNSTILYLKRKDSTEDVNMDSALNISQESLATPEDIDVDSERSDDPPFRPSGVGLGKGKPFYASKIAKKKLGLGPGRPKGSGKMSSIALSHFQKRPRYADFGRKRGAKTKMRGIFGVPGLGLQRPLMDSNTKPEDEPGLENKLVLVSSRDKYVLSQDVCVMCGALGQDQEACLIACAQCGQSYHPYCVSVKVTKVMLQRGWRCLDCTVCEGCGQRNDEGRLILCDDCDISYHIYCMDPPLGAVPSGVWKCKWCAHCQTCGSNSPGPNATWQSNFTQCGPCASRTVCPACLELYTDGDLIIKCIHCDRWLHCLCDTISNENEAEACCAQGYTCILCRPNNAALVLPATTPSRAPSPEINLESKATDYYVDGVCLSETGLQLIKTLSMDNGNQPVRRKRPGFRRQDPSVDLSVDDIENEGKDAVYKDGMIWGSKENGPIPSPPEGFTLYTRECGVVVLKRIKKRNLQRLGIGGFTTVKMRSSRFKEDDEHLYPEEKPRRKPRVPKKKSKIAESYPRHLQEAFFGKELLDTTKETSQELESTGDESDEGKLRVVEEESSNQENVSDKRREVANSSSSAKITIKEEEGSDGETLKDILHLPENLLHNDLVNTIMNESADSIKSENLMSESGHEGSGSQKDELCDILGPHFNIESMVRETGLPNMDSKDVEEIFKGVLTDESRNQSHHNQPSPHQQHPVPKSTPTGMASSPLQYPSASPYNSEYSNSPQFSPESSWDDCGSYNRTTSLKMEADESLGRDATISPVLYANINHPEWKKEYPSWNERFKQILKKWRALPSEEKAPYLQRARDNRTNFRSRKQEHDKTLNTKSCREAEQERQWKELQALRQQQQHMLSQTRVQQGTNTKDNYVIMNRVRQVGNAGLVQFSTNEQSPSPHLTQQLQVSTSTQEANLGGLGSPRAQFASGTGGTVKVATPGGTIYRQVRPPQSPFQSPRQPATPQQQQEEVRQLRDLLQRQQVKQEGTETVLSSGVLQGVQMRPQPPRSSLHPQVVHGMEPRVRLVVQQQASRFPGTTQVRLAAPRTQLQDQFLIQRQFAVAAAAQHAHNASAIIRNSSTLVDQTRLQTLPVDQRIQTGGRGEGEEIPESVTAELEKLEEEGGTIGGEADEVSAIFSDLVEDDDELLAEMGPDFNILEYADPELDTVSGGEKTNILDDLEDEVEKKKQVGSSRKEDTARRRSAESINKELTEPRPESKPSEEVNRVSVTSTPPHLPQQISLTGKSGIGQPKIVGSGYQTQFATPTTPLPRMQVLQGGNQVSRGGASFVGNPPPPPPPYPGPPPPYPGQQAAIRGRGVRSHIIPGPASQAQQRRTLLLQEQPLLLEELLEEEKREQEKASVTPSPASSLMSDADFEMLRADVLGSRTTSPPQSQSLGTLNLVGQPPPPPPENIVTEADRQAQIQYEAWLRTTGSAVSQQIRYFETEVQKLRKIRKSLNSKQRQLRKNGNELNEKDAIELQRVTGEQTTLQKHLEAARKQSRQHTMVMQEYQTKQDSKGGGGSAGSASPQSPLLSPAGGGIGGHQSHQPSPQTSSVSPVRHSPAGTPHSQSGDDKSEGSGLPSPRPPPMTPTPPSPHQFHQIRHPSMVSRFARSPEGGLRPRLAPLQTSGFNSPRGMSPQPPSPQTMRLTQQQQLLLQRHQLQQQKQQILEQHPEAGAILSRQLLRQEPQRQYRTFPGPQSPGSQGGSPLYSPRAPPSPMVYQGLQTPTSPMPQFTQPTSPMQSPRLQYAPSSPHQQQYRPNSPMVPSPMRRPSSASPQGEGGGGNPFNPNNPIPIPPEIRRLKLGLKGGSPMWSDKRKRVQPSTSSEKVASLVCVDYNDFEEESPPITPPSKPALIKKTENVKARQSEDTDSELTVYDDIVLVEGCKETNLEVAELRSALEGNVMSTVVSMPMVIDSGQIQMMDVEGELLDDLVVLGVGNGTTDSDCILEVNKDLILDDDVKEDELDDGSPPRARMQGKVLPGGGSHNSPSPESRNNCDIFKKVEEKSKKLEKERKSTDERTVPVQPNIVVSRTPTTFTPVVTQKSIPIADNRQLAMQQAAVASLVQDAVNAAKLAAEAQNLLKSSQANEQHRNAISRGNFVPLSVITSKAADSEPLVNNSIKSDLRKSELSRFQDVDNGQKEMPENKQEHQKFRLENASDLRIINTESSIIKYKTSESVDRHHAHNEINVIKENEETNDKREHKIVERINHVAPKVENVTLPCVSSSILEAQLTSMLRTSSEPTSNQNFIYAVVNHTVKDQRREENNQDDMRVEGLAAHFQRTVKNEELMLTESDIYKNSRNPHLNKKHGNIYVSSQIKTDTVMVGGKSYKIYQAGPQSSTSDILTLRDDKEEANGRVAHKVNTIERRLSVSNEKAANEMLQQRVVSSSETAEKETHHLSFGGPKAQVVAQKEEPKKFVALATMLLPRNNEEKRVRPGEDSQNVLLKQLLQNTACATTTTASLPIVPSLEAQLARPVPPTPSSLLPSVLNEPPKEIQQPKPQHQIIESPKQETRPHIGPSSLDELLSPPPPPQQLQHHPPSAIQTSPVIKREPVFSLSQPGPVMTPMVDVKREVEVKKEVMSSDEMLSPGLRLDQIDSQPQDIKKLKKRPYHHQKRRQSLGKEMIGGTPKKRPRKSSKVEEDYDSFIDSVMHQLRQTPGMSICEPNLTYNFTGCPPFGAGDMSKVNSCTRLGELRGTYGTAYLPHENDHYNTLPFGDLPPKAPSTPATQRGFYNEEFAPLKLHTAKDDFDDRKYDYNRDRDNDTPDTIISSSSPECIMPEFHPRFPGLQLIDSDNEEERFRLSRFSPDIPIIAPLAIRPKPIRFYSDMDKENETPDGERGRIRESVTVTLTLTSQAADDVLSVLRNLANVLRIPVPATHSITERSSASHRLGIYRLKGKDGKEGAQVDIQSILNGTAKFCRHCDVVIMNNLMRKKASEMPLVARQGEEDLYFCSTSCYMQLALSHPQGPNKEKALTIIDHLETPSKKTKVESTTDCNAVKIEPKKEFKLSSDPSYMTTRGSGKREKQSSAYDKTAVTNSYASHALGKKSPSRYRTWTTATIPPPSARHKKPTDKEITEMLFKSGITVMPLKLPEDSRHCLLCHQVGDGVTDGPARLLNYDVNKWIHLNCALWSDEVYETVNGGLMNVEIALQNGLSVHCAYCNTPGATLKCYKMRCSLVYHLPCAVKDQCVFFKNKTLYCSSHVPKNEKENELTTLSVMRRVYISRDENRQVAAIMHHSEQTSLLRVGSLIFLSVGQLLPHQLQAFHTPNYIYPVGYKIIRMYWSMRTVNKRCRYICSIADVDGKPEFRITVEERGEADMELRDTTPRGVWLKVLEPLAELRKVSSVVQLFSRYVTGEDLFGLTEPAIVRVLESLPGVETLSDYKFKYGRNPLLELPLAVNPTGCARSEGKPKGWKRAHTQRATSLRGGGSGPAFAPSAPLPGELACPYSKQFVHSKSSQYKKMKQEWRNNVFLARSKIQGLGLYAARDLERHTMVIEYIGEIIRSELAETREKQYEAKNRGIYMFRLDEDRVVDATLCGGLARYINHSCSPNCVAETVEVDRDLRIIIFTKRRISRGEELAYDYKFDIEDDQHKIPCMCGAPNCRKWMN

SEQ ID NO: 12335 - protein, 234 aa, Nezara viridula
EVLRFYYWDAAEEMYSQPGTVFFFGKILIESANTYVSCCVSVKNIERRIFLLPRERKMNLKTNETYGDPVTMTDVYQEFSSIVAEKYKIKQFKSRKISKKYAFGDNSVPAESEYLEIRYPSTSPALPSDLKGETFSHVFGTKTSFLEILLLERGIKGPSWIEITNAEPVLAPFTWCKVEASCMKASDVHVLKPGLPHIPPLVLVTLHPQAVHNPKTKQTEIVAVGCLGSNSYPV

SEQ ID NO: 12336 - protein, 479 aa, Nezara viridula
GKQSVRLLFLKGDMAAGTQVKNVEVRDIARIERIGAHSHIRGLGLDDSLEARAVSQGMVGQQMARRAAGVVLGMIKEGKIAGRAVLLAGPPGTGKTAIAMGISKSLGKDTPFTAMAGSEIYSLEMSKTEALTQAIRKSIGIRIKEETEIIEGEVVEIQVERPATGVGAKVGKLTLKTTEMETVYDLGTKMIDALTKEKVQSGDVITIDKATGKISRIGRSFTRARDYDATGPQTRFVQCPEGELQKRKEVVHTVSIHEIDVINSRTHGFLALFSGDTGEIKPEVREQINTKIAEWREEGKAEISPGVLFIDEVHMLDIECFSFLNRALEDEMAPVVIMATNRGITNIRGTNYTSPHGIPIDLLDRMIIISTSQYRESELREILKIRCEEEDCELSDDALTVLTRIAMETSLRYAIQLITLAGLVSRRRKSNEVEIEDVKKVYSLFLDEGRSTQILSEYQDQYLYDQKPDVGGSGEPMDL

SEQ ID NO: 12337 - protein, 369 aa, Nezara viridula
MSIRTYGDKPISFQVEENGEYYCIGSEVGNYLRMFRGSLYKRYPGMYRRTLGNEERKRLIELGLSSHCLASSISLLRASEVEDIIEGNDEKYKAVSVHSSETPITSSSKPKKAMPWVPSLPNSSHLDAVPQATPINRNRVVSKKVRSFPLCFDDTDPSSIMENASQMEVLVPIRLDMEIEGQKLRDTFTWNKNESLITPEQFAEILCDDLDLNPLSFVPAIAQAIRQQIEGFPTDNILEDQTDQRVIVKLNIHVGNTSLVDQIEWDMSEKENSPEQFAMKLCAELGLGGEFVTAIAYSIRGQLSWHQKTYAFSESPLQTVEVPFRPQSEADQWCPFLETLTDAEMEKKIRDQDRNTRRMRRLANTTPGW

SEQ ID NO: 12338 - protein, 217 aa, Nezara viridula
TAALWARNVHLVLLGVVLSGYCFVMAAIRKKLVIVGDGACGKTCLLIVFSKDQFPEVYVPTVFENYVADIEVDGKQVELALWDTAGQEDYDRLRPLSYPDTDVILMSFSIDSPDSLENIPEKWTPEVKHFCPNVPIILVGNKKDLRNDPNTIKELAKMKQEPVKPEEGRAMADKINAFDYLECSAKTKDGVRQVFETATRAALQVKKKKRNRKCKLL

SEQ ID NO: 12339 - protein, 1321 aa, Nezara viridula
MNLSLSNYERVPPLDCYQPSGNLLDLADRMLEKFTVEDNNLPQLLDRLQITCESGTTSSGTKDTDYINNVDSSYLSQISQFRLINKIPLPQEISDQFTTLAAGSSGDTTTMGMFPDINRAWMAVESDIYLWNFETGGDVAYFDGLSDPIVSVGLLAPRPGVFQSFISHLLILTTPVEITVLGVILASSSDRKVGDELQLTPDTIYTLSTDGVPIRVIKGTKNGRIFLGGKDGNLYELVYRKEMSWGGKRAWKVNHTKAILSYLVPTFVSGAFSEEDQITEITVDESRNILYTLSIRGSIEVFDLGRNGDTTCRVASLHHSFINRSTVDLIRNITPPDVSRVVSLCPISENDSPHFGVVGVTENGIRLYFTTGSPPRPSTLSLLHARLPPGHAPNTSNVRIGRVAMAIHKSGTFIMVSSMGDYSPDRLWCFTMDGLSALKLPLTEFVFTNPQNASIAIAESRENMSLTDRGLHGHFLVYQQNYPQDRFIILSQQGTDIYEKLRPVDIFGELMREKGGPDCEEVKQFFAQHGSDQACAMALILACDETNQHMAEWATRAFFLYGGDPKYVLQTIQQPIQQPTMTNPLQQSIMHHTLPLGFKPGTVSTPLGEKQVQPSRSIETYGVSMSSKHNGLYIFLSRMLRPVWLRRVLDVNYNKKPIYLPTITCEELSLKTVQLYELRSFLARYTLSSSDVGTSLQPANNTTVVSPSGQRTRLQEALIQEKASLDALRNFVERITQVFSLWKLLCDHELPLIVESLSPESQDQLIHITFREFILKGEDLCHELISKLVSLYLNDNASVDPISSKLREVCPLLYKNEDATCTKVNEILQMALDEVDEEAKLNLLRSAIDLCKNVSPNVDIDSVCKSLVKCGYYDGVLEMCQDVASKSDSNSLASKFIARGRPVEDVEGSKAFEARHKAYQQIVHLLDFLYQQCQLGGNNIPPLFGSADLSSHSQKLLEATLEKCLSVEDETCHIVVYDWLVSRELQASLVSLGRPSVERFLSRYPVDSPLRDLLWQYHEKSGNHAPAANILYKIATAPGEFITLHQRLTYLGKAVMCMRSDGVGCASHLGVFLHELEDLVHVARVQKQILERITSMPDVSDINVQDACRKLNANLLSITELYESFAEPFGLWEQKLAILDCAGHDDKELINSIWDNIILKELDQCNSRDPSGQMVVLVSKVRSLGLQFGIQSPCFPIEYLVWQLELISCKLGVDKFHVHNIMTSLGVPYSTLLDIYSKMYSANDNCWLESDNEFHLIQVIASFCESFSDNKQLTTSAQERKSTAVLMHDLINECIIVLHSKTGLGELVGYLKSIQTKLERI

SEQ ID NO: 12340 - protein, 1210 aa, Nezara viridula
MSGSDFYGADTLHKEVYIRKGHEDWNEINLNPGGIASTLQDVKTQQRAGAYAYKKIPNRFIYWRTEGNVLEMVEESLDVTLHGNQIRYKFTDSQVLDGLTVTETMKRLIILVPTVSSLHVFTYPHPEKLLKKGFGEVSSLSVFHGISESDATDPQTYHQLNCSSSAIVSCTSCIANNGEAIFALGLANASVLLVIVDSVSGLSSSRILSHDNIVPRFLTGILGKDGGEWVPVSLILHYIKKELFLFTLCRGGSLRVWSVDRGSFITSLCVKLTSQTTLKAQKHKMCKGYINGTFILHCCVQGAAIVTLAPDYGNGVFNFTTISEIPIQPGFEVTNMCPGEEGYFWCSWLTLDESPAVTKNNVIHPGFSKVALTRPSLQVPVSDYIPRDPASHYLDAIFSSGFFTSLDIAKAISLYKITAVIKPNIDVAEQICAIVETEIYSEIGEQELDDDEFLDIAFRCWNRLYSCCSQYIISSMLPLGMVWLGDYLVLIQECGFSIVVDIEPLELFMTTAVKSSQFPQVGYGWLVEKLRDINLESGIVKLELSIHTGESIDELSILQEAADLIHPSKQLDDALSIFYEEGLGRSLNCLIEELAVPEDFNKDGTWESFCSYSGVGAVTSAFRDYVAVRLKICEKMLLLTELAMRDDDGAADRTQHRSLAALCKAYYILKWICTSKSTGNAPMIHVFSLVNPTSIMQSSLEQCVLGLANCLWPLATNSTLAQHLLSTKQYALLQTFARLVGINNWSLLLAESYILTGQPGKAFDVCLKNAGSDVVHFLNAIRLFEKHSRSDLVIEMATKALELLIVSHSDRETLESALFVHELGMENYDAAWSWIESCSSWSRRSDFLQRLVANMISEGKLTDLISFSYTGLLDELEKLLASRARSLTFGLATNYYNILYAFHVKHENFKKAASIMLEKALRADTAEVQWKCYGACLSSLMLINDPQQAWLVRPNPFSQEDAVEILEIEDIQREFELSGARYNLDGCSPDASQEEVIALCVTQKLYKTALRLANMCKLSCAPCIQAFTASCAALSEQSISWHWLKANEIDDIIITESNANEMLWRILERCILKYEKENETVLHRASANQLLTVGLFIPTWLLQSYKKRNSSELLRLFVQHGYLEEAEELACEYLNAALGIGREHFSIDFPLHLSSPPLCLPLQTIDILLLELKHYNIGDRLQKKLDTYVNTISRITLERPMIVSTKKNNL

SEQ ID NO: 12341 - protein, 966 aa, Nezara viridula
MEISEENLHTLTNYLMQTLSPDPNVRRPAERFLESIEINKNYPILLLHLINKEDVHYTIRVAGAITFKNYTRRNWPINDDNLENKIDPEDRQRVKELIVDVMLVAPSSIQKQLSEAIGTIGKCDFPKDWPGLLTNMVEKFAGGDFHVINGILQTAHSIFKRYRYEFKSQKLWEEIKFVLDTFAKPLTDLAVATQNLTQVHATNPDALRVIYSSLLLISKIFYSLNFQDLPEFFEDNMNIWMPLFHTLLTTDVKCLHTDVDDEAGLLEQLRSQVCSNIALYAQKYDEEFQPYLQGFVTDIWSLLVSVSLQPKNDLLVSNALQFLSTIAERQQYRHLFEDKNVLTGICEKVIIPNIHFRDADLELFEDNPEEYIRKDIEGSDVESRRRSSSELVKVLAGHFPETVRTIFGARLQEMLGEYNSDPGKWRLKNTAVYIVTSLAERGSTAKHGVTKSSDLVDLHDFAGQYIIPELKKEVNTLPVIKADSIKYLITFRSLLAPQVVIAAFPDIVKHLSSPSLVVHSYAASAIEKLLILKQNNQPLITQELLRPIAGELLTGLFNILNLKGSEENEYAMKAIMRAFSTLDESVIPCLAELLPKLTQKLTIVAKNPSRPHFNHYLFETISLSIRIVCKNNPGAVSAFEEALFPTFQIIFQEDVQEFVPYCMQVLSLTLARRSPPLPAPYVALYPCLLSPQLWDRPGCVRGLVCLLRSYVRVSSNDDFNQTVKVNGLLGVFQKLISSRLNDHEGFYLMQSLIEHCPRELLDPFMKQVVLLLFQRLTAAKTTKYVKGLITFFCLLVVKYGAPTFIELVDSVQPQMFSMVVERLITPDCRKVSGSVERKITVVGLCRLVADLKQVFSGPYSACWPALAKSVVELLEAPEDDSVAPEDHFIEVDNLPGYEPAYVHLTAIGSDKHDPFPDISDLRRELANGIGSLFKVSGQVVTQAIANLGEPYTSHIKSYLTLIGVII

SEQ ID NO: 12342 - protein, 191 aa, Nezara viridula
MAKVQIGNVLVLDNPSSFLNPFQFELTFECIEELKEDLEWKMIYVGSAESEEYDQVLDTIYVGPIPEGRHKFVFQADPPDVTKIPIEDALGVTVVLLTCCYRGQEFVRVGYFINNEYSDPELRENPPAIPQFDKVVRNILGSEPRVTRFKINWDDSESQDQPSQESEEQQQTTENVGFAENSGSHNFMEVS

SEQ ID NO: 12343 - protein, 296 aa, Nezara viridula
MDHMLASPFNLPSIGTPVHQPEEDQQILPIAQQQQQLQPPLQMPPLLPIQSSINQPKPMNTYAPSMGFTTPQSMMHPQTPQNLMSPMVNRMDQTPNSIINPTTPGPMTPMTPSSADPGFMPQLQNIVSTVNLGCKLDLKKIALHARNAEYNPKRFAAVIMRIREPRTTALIFSSGKMVCTGAKSEDDSRLAARKYARIIQKLGFQAKFLDFKVQNMVGSCDVKFPIRLEGLVLTHGQFSSYEPELFPGLIYRMVKPRIVLLIFVSGKVVLTGAKVRQEIYEAFDNIYPILKSFKKQ

SEQ ID NO: 12344 - protein, 160 aa, Nezara viridula
MASVGTTRSVLRLLSSQPILKQAVRGYADEMAFTFAAANKVFYANSNVKQVDVPSFSGAFGILPKHVPTLAVLKPGVVTVFEQDGSSKKVFVSSGTVTINEDSSVQVLAEEAHPVEDLDASAAREQLSKAQGDLSKATSEQEKAEALIAIEVAEALVAAA

SEQ ID NO: 12345 - protein, 311 aa, Nezara viridula
MPSDEQDKFDGMLLAMAQQHEGIKDLLDTFFSFLARKTDFYIGAQADAAKSLVLDSFEKYQSKANLAAEKKRTESVEAEKKRKEKLAAKATPKVMEITDEEAKVIEDEEKKRKEDEEIALSKPITETEGEDEEQDKGKLMPNAGNGADLENYRWTQTLQELEIRVPLKTTFNVKSRDLVVDLGKTHLKIGLKGHEPIVDGELEHEIKIEESTWVIEDGKTLFLTVEKVNKMEWWSRLLATDPEIATRKINPEPSKLSDLDGETRGLVEKMMYDQRQRELGLPTSDEQKKKDMLKKFMEQHPEMDFSKCKFS

SEQ ID NO: 12346 - protein, 142 aa, Nezara viridula
MTTPWSPDKKHSDRERWICIYPAYLNSKKTRAEGRIIAKDKAIENPTYQEIRDVLSAAGLKVGVENKLYSREKSKELLYRGRIRVQLKNDNGTPLNPDFATRESVILHACSMIPKLKTRQGGKHTTEQSQGGTSKKKGKGRR

SEQ ID NO: 12347 - protein, 676 aa, Nezara viridula
MEKPQKMPKVAKVKNKAPAEIQITAEQLLREAKERDLEIVPPPPKQKISDPEELADYQHRKRKAFEDNIRKSRMVISNWIKYAQWEESQRQVDRARSIYERALDVDHRNITLWLKYTEMEMRNRQINHSRNLWDRAVTILPRANQFWYKYTYMEEMLGNIAGCRQVFDRWMEWEPEEQAWLTYIKFELRYKEIERAREIYTRFVMVHPDVQNWKRFAGFEERHGFISGARKVYERAVEFFGEDIMDERLYIAFAKFEEGQREHDRARVIYKYALDHLPKERTAEIYKAYTIHEKKYGDRTGIEDVIVSKRKYQYLEEVRTNPINYDAWFDLLRLVEEEGNVDTIREMYERAIANIPPSREKDMWRRYIYLWINYALYEELEAEDEDRTRQIYRTCLDIIPHKTFTFSKIWLLYAQFEIRHKNLSTARKTLGMALGVCPRDKLYRGYIDLEIQLREFDRCRTLYQKFLEHGPENCITWMRFAELETLLGDTDRARAIYELAVNQPRLDMPEILWKAYIDFEINIGESRNARQLYERLLERTHHVKVWMSYVKFEMSHSEEEGIEPISLARRIYERGNIALRESGEKEERILLLEAWREMEKVHGDEESHKKVEAKLPRRVRRRQAVIAADGTEEGWEEVYDYIFPEDEAVKPNLKLLEKAKAWKKKQEADIQTNDED

SEQ ID NO: 12348 - protein, 476 aa, Nezara viridula
MAIKFLEVIKPFCSILPEIAKPERKIQFREKVLWTAITLFIFLVCCQIPLFGIMSSDSADPFYWIRVILASNRGTLMELGISPIVTSGLIMQLLAGAKIIEVGDTPKDRALFNGAQKLFGMVITVGQAIVYVMTGMYGDPAEIGAGICLLIIVQLFVAGLIVLLLDELLQKGYGLGSGISLFIATNICETIVWKAFSPATVNTGRGTEFEGAVIALFHLLATRQDKVRALREAFYRQNLPNLMNLLATILVFAIVIYFQGFRVDLPIKSARYRGQYSSYPIKLFYTSNIPIILQSALVSNLYVISQMLAVKFHGNVFVNMLGVWADVGGGGPARAYPVGGLCYYLSPPENLGHILEDPIHAMLYIIFMLGSCAFFSKTWIEVSGSSAKDVAKQLKEQQMVMRGHRDNSMIHELNRYIPTAAAFGGLCIGALSVLADFMGAIGSGTGILLAVTIIYQYFEIFVKEQSETGGMSTLLF

SEQ ID NO: 12349 - protein, 203 aa, Nezara viridula
RHCFDRLFVVVFRFSWDVTVWCVFYCSNVKFVKMNLLKAMSPTSVTPSVELSTYRDQHFKGSRTEQERLLRVSTTLYIGNLSFYTTEEQIYELFSKCGDIKRIIMGLDKYKKIPCGFCFVEYYQRPDAESAMRYINGTRLDDRIIRTDWDAGFVEGRQYGRGKSGGQVRDEYRREYDAGRGGYGKVMQQPTTKAEAASIFNGQ

SEQ ID NO: 12350 - protein, 311 aa, Nezara viridula
MAAAVGRIYGSRLLKNNPVSKHLQIGSFSTTKSWSRGKKALYTSLGILTGGTGMLIYALEKSLQAGDLELHPPKLPWSHSGYFQSLDHASIRRGYEVYKNVCAACHSLRFVCYRDLVGVSHTEAEAKAEAEEQLVLDGPNEVGEMFKRPGKLSDHMPSPYPNEEAARAANNGAYPPDLSYIVPGRHGEEDYIFHLLTGYCDAPEGLILREGQYFNPYFPGGAISMAQALYNEIIEYSDGTPATQSQLAKDVATFLKWTSEPEHDVRKQMALKVIFIFSLFIAAAVYWKRHKWSTLKSRKIVFRPPPSPPKL

SEQ ID NO: 12351 - protein, 572 aa, Nezara viridula
MLALQQYGESDSDKEDEEKQNINDEALLHLKPLSESSIIQTAICPAPTALPPVEYNPLKFIKPGCTEMTVNLKYEELFAADVGPENPFLTDQQKAPKNILSGYVEAAHMSEFQFENQRKTFQSYGYALDPSIDNMGRTEDSIPVVGAVDVAKETNLKTVFESTSKRPLDKRKRNKNDDPADINGFLGPWGSYVDEKKVVKPDPEVAAELEEYLAKRQKLGKKVEDKPLEEKTVLHIKDPVDYQGRNFLHPPQDVGVNLKSDSPPDKCFIPKSEIHVWKGHTKGISAIRWFPKYAHLLLSCSMDCRVKLWEVYNERRCIRTYYGHRQAVRDVCFNNRGTKFLSAAYDRYIKLWDTETGECISRFTSRKIPYCVKFNPDEDKQNLFVAGTSDKKIICWDLRSGEIVQEYDRHLGAVNSITFVDENRRFVTTSDDKSLRVWEWDIPVDMKYIADPSMHSMPAVTPSPNQKWLACQSMDNKIVIFSALNRFKLNRKKTFTGHMVAGYACTLDFSPDMSYIVSGDADGKAYVWDWKTTKLFKKWKAHDHVCIGVLWHPHEHSKVVTAGWDGLIKYWD

SEQ ID NO: 12352 - protein, 268 aa, Nezara viridula
MVQKKPKKKTGKKVAAAPLAVKKQEVQKVVNPLFEKRARNFGIGQDIQPSRDLSRFVRWPKYIRIQRQKSVLQKRLKIPPSIHQFSQSLDKQTATQLFKILEKHRPETALAKKQRLKARAEGKIKQKEEVPTKRPNVIRSGVNTVTRLVEQKKALLVVIAHDVDPIELVLFLPALCRKMNVPYCIIKGKARLGRLVRRKTCTSIAVTQMEGNDRTALNKVIEAVKTNYNDRYEEIKRHWGGGLLGSKSAARIAKLEKAKARELAQKQG

SEQ ID NO: 12353 - protein, 334 aa, Nezara viridula
MANMLKDVTIDDKMPNELLLDKHIKFVLAYGANKDEFEFCTTEHLRMSGMYWILTTLAVTKKLDEVDKKEFIDFILECTDEKTGGIGACVGHDPHILYTLSAVQIACILRSLDLLPLEKIVSFVASLQKEDGSFMGDKWGEVDTRFSFCAIACLSLIGRLDAINLEKAVDFVLSCQNFDGGFGSQQNSESHAGLIYCCVGVLSITQNLYRIDADQLGWWLCERQLPSGGLNGRPEKLPDVCYSWWVLSSLTMLGRLHWIDKQLLKKYILASQDSDGGFSDRPGDMPDPFHTLFGIAALSLLGESDLLKINPTYCMPQYIIDELNLDPEIMQSQP

SEQ ID NO: 12354 - protein, 895 aa, Nezara viridula
MMLKMNSEATAQLIQILEKTVSPDKNELEAAQNYLEHAAQTNLAEFLQTLSHILQHGGNSPVARMAASLQLKNNLTSKDQNIKAQYQARWLAFPEETRMYIKKNILGALGTENTRPSSAAQCVAYVAVAEIPVGQWPDLIPTLSANVTGPTSTEIMKEATLEAIGYICQEIEHDCLASQSNQILTAIVHGMRSGERSNYVRLAATTALLNSLEFTRANFQQDMERNYLMEVVCEATQSTDTQVRVAALQCLVKIMTLYYQYMETYMGQALFPITLEAMKSDIKEVALQGIEFWSNVSDEEVDLAIEESEAVEMGKPPARTSRYYAKGALQYLVPVVLTKLTKQEEFDDEDDWNPSKAAGVCLMLLATCCEEDIVPHVLPFVQQNIKSPDWRYRDAAVMAFGSILSGLHSSTLKPMVEQAMPTLIELMYDSSVAVRDTAAWAFGRICEIVPEAATNETYIKPLLESLLNGLKAEPRVAANVCWAFTGLAEASYDQAENQVEDGSQPETYILSRYFEYIVHSLLATTDRVDGAQANLRPAAYEALMEMVKNSPKDCYTVVQRATLIILDRLNQVLAMEQQIQSHSDRAQFNDLQSLLCATLQSVLRKMTPEDAPQISDTIMNALLQMFNSNSCKSGSVQEDAIMAVSTLVEVLGDGFIKYMPAFQPFLCMGLKNHAEYQVCCAAVGLTGDICRALKNKVLPYCDDIMRLLLENLSDNSVHRSVKPQILSTFGDVALSIGSDFKKYLDVVLHTLMQAAQAQVDTSDFDMVDWLNELREGIVEAYSGIIQGLKGEDNNTAVSVANLALLEPHIPVMAQFLTCISRDTSKQDKVLAGSAGLVGDLCSAFGPKVIPLLDIDPINELLTQGRRSRINKTKAVSNWASKEMRRYKATIANAAS

SEQ ID NO: 12355 - protein, 501 aa, Nezara viridula
METILEQQRRYHEERERLMDAMVKEMLHKKSSYREQINSDHRLKMLLDQYMESTHKLKELYEDKDGIRKDEVAALSGPNEFSEFYSRLKTIKEFYRRIPNEISVPMSVEFEELAKLRENPTEETSNLVEFTDEEGYGKYLDLHECYEKYINLKGVEKVDYITYLTTFDRLYEIPKDRKSSEYKRYVIMLLNYLCDYIARIKPLLDLDQELTNVQKDFTSQWEAGTFPGWPKETGSVLSNVGAHLDLSAFSSPEELASLGLDRLKSALMALGLKCGGTLEERAQRLFSTKGKKSLDPNLLAKSKPGKSNRERDLERQRDIAFLEAQAYKLAELLSEQRAATKENVQRKQARTGEERGDSEGEASSSGSESEGEDDGVPYNPKNLPLGWDGKPIPYWLYKLHGLNISYNCEICGNFIYKGPKAFQRHFAEWRHAHGMRCLGIPNTAHFANVTQIEDALALWEKLKTMKHDERWQPEHEEEYEDSLGNVVNRKTYQDLKRQGLL

SEQ ID NO: 12356 - protein, 211 aa, Nezara viridula
MTVGKNNKMLQHINYRVRIILQDSRTFIGTFKAFDKHMNLILGDCEEFRKIKPKNTKQPEREEKRVLGFVLLRGENIVSLTVEGPPPPEEGLPRVPLPGAGGGIGSARPAGRGVPAPGTPAAPGLQGPVRGVGGPSAQVMTPAGRGGQVSAPPQMRAPPPGMPPMMGAPPMMNMAPGMAMGRGGPPPQMGAPPAPPMRGPPPGMMRGPPPF

SEQ ID NO: 12357 - protein, 479 aa, Nezara viridula
MADVELVDAVGAIVLEIQRRTIKKKRRIWTKNWFLKRNQLRQSQVLVKELLSEDPLSFLNMLGMNMVMFDSLLEKIGHNIQKCDTVMREALPAKVKLETACRYLATGESMASMQYLYSVPKCTISKFLPDVFDAIYEGLKEFIQIPATESDWKEIQKGFSDLRNFTDCVGCIGGKHVMVKCPTNLGSQYFNNKGTLCIVLLAMVDYNYNFTFIDIGNYGSIEDYGIFAKSSLMKVIEQNQINMPEGAVILGDSTFPSKSYSIKQYPTEKNLNVAQEIDNDRHYHAKRFVENSFDIFTSRFRVLRKPIHLLPETVVKMTKAACALHNWIRKSTNLIMTANNEDNGCSGRIIRESWQKDDYRVDDVANVMPLLQHNYVPDTREKRGEFLKYSTKKVAVSCQMTEENDCLLKETEQKEEINTSEQACAKKLTSHPLPVLHSQHQSSPSQPTAFQPPRRINFTNQQRRRRKGGLQSQRKKNKF

SEQ ID NO: 12358 - protein, 685 aa, Euschistus heros
MSSKHKHKRYEEEEERRKKHKSRYSDDSEDGRKSSSSRHRSKKKKHDHSHKHKKENKKKSKRSESSDSSTSSDSSSDNSVKLLKRLHDKHEKMIQQKKKEKELMKANETPEEKRIRRLLKKEAKERKRKQRMGWDKDYLHYTNTDNPFGDANLLSTFVWSKKLAKDGLTDVSREELERINRIKQEENKIELEKVKKRRQEREQERQEREEAMMRLQREKEAEQFEAWATQEDQFHLEQARLRSRIRIADARAKPIDLLAKYINSEEEVDAVEMHEPYTYLNGLSIKDLEDLVEDIKVYMKLEKGKNLDYWNDITVIVEDELYKLRKLGKKSDYEAAVGRREGIHESVAKEVSSVFRGKTASQLAAMQKQIEKKISDKGEGIDIGYWESLLSQLKAHMARARLRDKHQENLKQKLELLKAEQRHQEQEIKEEPIDESEEQQEAVVSDEIKQEKDDSEEEEGSGGEEDAGESMLKESFGEYEAGAYSPVYVDPASLEPGTLIIGEEEDAQRLEYARQHLTSHESQAGSTSEELAMQREARKGMSSDEAIFSVESALDSQVYLWSDKYRPRKPRYFNRVHTGFEWNKYNQTHYDMDNPPPKIVQGYKFNIFFPDLIDKSTTPEYYLTTCPDNPDFAVLRFHAGPPYEDIAFKIVNREWEYSYKRGFRCQFHNNIFQLWFHFKRYRYRR

SEQ ID NO: 12359 - protein, 401 aa, Euschistus heros
MGDANIIDKSMRSVFVGNIPYEATEEKLKDIFNEVGPVLSFKLVYDRETGKPKGYGFCEYKDQETALSAMRNLNGYEIGGRSLRVDNACTEKSRLEMQSLLAGPPIDNTYGESVESDKAPEAISKAVASLPPEQMFELMKQMKLCIQNNPTEGKAMLLQNPQLAYALLQAQVVMRIVDPQIAITMLHKANPSVPPLQPPPVETIRPVPVPQPAPAVAPPPVVPPVVQARPVEPEWVPPARPHQPPHPPTFIPQPGGDLDMRTLDPRVPPVRLNQDQDLRIPPMVPAPQQPPAQPPQPYPQEHVISSTVRDPRQYRDPRTGAATVPVPPRPVVAQAVVPPRPVAPPASHITSALPPAASDQEKAALIMQVLQLSEEQIAMLPPEQRQSILVLKEQIAKSTQR

SEQ ID NO: 12360 - protein, 395 aa, Euschistus heros
MTASQGMEPNREKALQDYRKKLLEHKEVEVRLKEMRDQLKDLTKQYDKSENDLKALQSVGQIVGEVLKQLTEEKFIVKATNGPRYVVGCRRQLDKSKLKSGTRVALDMTTLTIMRHLPREVDPLVYNMSHEDPGDVTYSAIGGLAEQIRELREVIELPLLNPELFQRVGITPPKGCLLYGPPGTGKTLLARAVASQLDANFLKVVSSAIVDKYIGESARLIREMFNYARDHQPCIIFMDEIDAIGGRRFSEGTSADREIQRTLMELLNQMDGFDSLGQVKMIMATNRPDTLDPALLRPGRLDRKIEIPLPNEQARLEILKIHAGPISKHGDIDYEAVVKLSDNFNGADLRNVCTEAGLFAIRAEREYVMQEDFMKAVRKVADNKKLESKLDYKPV

SEQ ID NO: 12361 - protein, 258 aa, Euschistus heros
MARRYDSRTTIFSPEGRLYQVEYAMEAISHAGTCLGILANDGIILVAEKRNTNKLLDESVYSEKIFKLNENMICSLAGITADANVLTNELRLISQRYLLQYGETIPCEQLVSWLCDIKQAYTQYGGKRPFGVSILYMGWDKHYGYQLYQSDPSGNYSGWKATCIGHNSGAAVSSLKTDYKEGEMTVKDALALGIKVLSKTLDTAKLSVDRVEVATLSQQNGKCVTCILPPDQVQELINAYEKSEAEANALKKEKTPKS

SEQ ID NO: 12362 - protein, 880 aa, Euschistus heros
MTKVQDPQPEEMSEEDKRLQEELNMLVEKITGPDTHLYVPALESMRDLIRSSTTSMTSVPMPLKFLRSHYGALKEACAVMADRKAQELCASIVSVLAMGQDLPGARECLKYCLQSHQKDVGDWGHEYVRQLEGEIADEWASTEEKDKLLGLVESIIKFDMEHNAEIQACDLLMEIDRLDMLDKHMDLTNYSRVCLYLINCAVYVEEPERGNIVSGVMKHYMRFKEYPRALCLAMQLNKQDIMLDIFNQCQDPLVRKQLAFMVGRQQLSLELSDDLADKSDLTNIMSNAHVNDHFHSLGRELDIMEPKTPEEVYKVWLEGLVLRPTYNLEVPLDSARHNLASTFVNAFVNAGFSRDKLVSVEDGNKWMYKNKQHGMLSAAASLGLIHLWDVDGGLTPIDKYLYTSEDYIKSGALLALGIVNCGVRNDCDPALALLSDYVLHESVTLRIGAVLGLGLAYVGTKRQDAITLLLPVLSDSRSTPEVVAMAALACALITLGTPHPDVVSTILQTLLDLPVAEMTDGHYSKFLPLALGLCYLGQREGTEATKAALEALPEPLRSLSQHMLKMCVYAGTGDVLVIQEQLQVCSEHYPTPEEKKESDKKDKDKDKDKDESKSSKVKDMTCMQAVAALSVAVIAMGEETGSEMATRIFAQLGRYGEPAVRRAVPLAIALSSISNPQLAVIDVLNKYSHDLDEEVAHNAIFSMGLVGAGTNNARLATMLRQLAQYHAKNTGHLFMVRIAQGLTHLGKGTLSLCPFHTDRQVMNYSAVAGLLITLVSFLDTKTIMLGKSHYLLYTLATAMYPRWLVTLDEHLEPLPVSVRVGQAVNVIGKAGTPKTIAGVHTHTTPVLLAVGERAELATEDYTPLTPVMEGFVILRKKQPA

SEQ ID NO: 12363 - protein, 418 aa, Euschistus heros
MEPPAAEQSQQQQEQESGVIRQRTITTSGTITTSPQHEATPSPEQPVQEQSGKEVEVPYEIVQLRPGSYDEGYSLEDTTRYSPGSGRYYTTDGTVKYDRDDKGEGSYVTLEPVNYPPGSAYQEPATGYYTYKEEEDVYIKAETPLTPKNFAHFDHPVTSHPTQLSAQVTYVTGGGSREYVTTNQPGYWSSEYVYQQPQQEIQLPPGTPYVFSSNGQATWAIDESYDPSMLSASDIKECVNCAASVTPLWRRDGTGHHLCNACGLYSRINGVHRPPIGNRRNGVSCANCQTNNTTLWRRNNTGEPVCNACGLYFKLHGVNRPHTMKKEGIQTRKRKPKNPQVNIPSPKNDIKAPGEKSGSWDKCDNDLLDSGYTMATSSIFLPSSFLTKPVGVSVSGMESVPPSVIIPPTSSQETQRTE

SEQ ID NO: 12364 - protein, 1834 aa, Euschistus heros
MSLAGGKMACPGNGIYVIQGEMSVLLTAMKKVNRWSSHVHQDDENDILIRSFTDLKDVLNQIGDLREVEPNHFLSPFLEVIRSEETTGPVTSLALSSVNKFLSYGLIDSKSKTIAATVENIAEAVTRARFVGTDQTNDSIVLLKILQVLRTLLLSPEGCWLTNESVLEILLSCFRMCFEPRLNELLRRCAENCLRDMVQLLFSRLPSFTEDNRKTYTIQQKLKMNTSAPLDAGKGKKKTSRPSSRKVSRKSQEKSPSPVLGSEVSAALKESESQQLSLPDEPETTSHGKSESERLLVPSEESLAKIPSTDSLETNVVNGVPNVIAAEENQNITPPVILDDGVIISIEDSSSQNSESTDQLATIGIVPEAKRPEDLDLNPTETNISSPSDLKSEEEPLLSPTTPENNMEGQDWTNQQGVRFTNTENDTLTPSGPYGLLSVHELLRFLASLCNPLDKQNSDSMIHIGLTLITVALEVGADSIAKFPSLLSTVKNDVCRSLLALLNTEKLPIFASVLQVSFLLFESLRTHLKFQLERYLSRLTEIIVSDSSKISYEHREIALESVVHLWRIPGLVTELYLNYDCSLYCPNLYEELTNLLSKNAFPVTGVYNTHLLSLDALLTVIDSIESHCNSRILNERQNPSKDGEINKLEFHDFASNYINRTGTRQKLSLNIPSHEQLMAVKRKKKLLATGTEHFNSKPKKGIQFLQEHNLLSTPLDAVEVVAFLRENPHLDKKMIGEYISNRANIAILDQFVKSFDFTELRIDEALRLYLETFRLPGESPLISLVMEHFAEHWHKCNGEPFANADAAFTLAYAIIMLNVDQHNHNVKRQNTPMTTEAFKRNLKNVNGGQDFEEEMLDDIYTAIKTEEIVMPAEQTGLVRENYEWKVLLRRGAGSEGYYVHAPNGLLDHDLFSLIWSPTISALSYLFDKTNDPTIYQKAISGFRKCAMISAHYGMSNDFDNLIVSLCKYTMLHYTSESPENLTISFGSSPKARRAAKTVFDLAHRHGDIIRESWRNILDCILQLYRCKLLPKILVEAEDFIELSGKISLIREDIQLSPKTETGILSSLYSYIALGTETNTQKGPSVEDQEAIKLAQNCIRECHLEQLITESKFLRIDSLQHFVKALVTASYGPEGHVSLGTSYSEDTAVFFLEVLLKVVIQNRDRISSIWCSVKEHIYTLLMGAAACDHHFLVERSVVGLLRLAIRLMHKEEMGPMVLQSLRMLLLLKSSTLSRVSRQISYGTFELLKTSAANIHSATDWAIIFTLLECVGAGAPPPKVVSKPVSSTESGARSEGEAQVDSGLGNERGYTSDSELSKAGSVPLSPSLSPEAPLSNTPTGWILVGREGEIQPVSCVRRAMLPELSRYDPLSMVKCVDSLSFLVRDVVHITPYNFHDCIRCIRTFVEAAANTERKSRKAGRDTARQAKRKNAKRREERGPSPTGSAYDADESDPEDSPGYQQVCIQLLELMHTLHTRTAQIFRWWAEETGQKEVGSPSYWTPGWCPLLQGISRLCSHPNRAVRMSAITYLQRALLMQDLQSLPGEEWEECFTQVLFPLLSTLLAVNIPAIEETRIRAATVLSKVFLHHLAPLQTLHSFAQLWLTILDYMDKYMHADNSDLLYEAIPESLKNLLLVMDSAGVFNGLDGRNEIWVVTWDRISSFLPNLQSDLFKDHLPVVDANLLETKEALETSKSETEVVQTEQPTLQRPPSSTQVVQSPPQPTSMPKPGEAVEISGPTSNNNVGSQNWQPPAPVYPHLEQMVSTPIGPSVPVYSGFASMPQQPPPPSAQFFYQDMSSSVPTNMAHNSEQPAVGSSLLLASAGLEHPKLPVISPPTSS

SEQ ID NO: 12365 - protein, 205 aa, Euschistus heros
MSILSYNGSAVIAMKGKDCVAIASDLRFGIQGQTVSTNFEKIFEMGPHLFIGLPGLTTDTFTVLNKLQFRKNMFELKEDRKIAPDVFLSMVSNLLYERRFGPFFVEPIIAGLNPKTMEPFIASMDLLGCPNKPEDFVVAGTASEQLYGMCEALWEPDLGPDDLFETISQALVNACDRDALSGWGASVFIIEKDKVTHRRIKTRMD

SEQ ID NO: 12366 - protein, 925 aa, Euschistus heros
MESPPSLETVHQAVYALYHNPDPAEKEKASLWLGQLQKSVFSWKIADEILHTSTDVECCYFAAQTMRTKIQHSFHELPAESHLPLRDSLMDHISKINESTNSVIGTQLYLALADLALQMVSWEKPAIDLIERYSATSVPPLLEMLTFLPEEVNSRALRLGSNRRRELLNKFSLAVPNVSEFLKMCLNNSGNNPQIQVKVFKCFTSWVSVQAMTLNDVTDNIVVATAFHVLANRMASSNLHEAAADCVCSLLECLEDNNNQQSIEMQLFNGVISLEQPFHISVAHEEHEKCVNYCRVFTELAESFLEKIVSGSSPNKAHFAIKIFDLVLTCVGHHDYEVAAITFNLWYRLSEELYQKKNSGLTSLFKPYIERLIEALCRHCQMEPDHEGILEEGDDFPDFRMKVAELIRDVVFIIGSSNCFRQMFISLQGPNTTWDTTEAALFIMQAVAKNILPEENDVVPKVVEAILNLPPNTHIAVRCTSVLLLGELCEWIEKHPHYLEPVLNMVLFCLQQPQLANSAANCLQSICSMCKNHMVTKFLGLLQILQSLDKFVLTNESVVGLLKGVACILSIMHPDQLQQAMRDVCLIQIKPLVHLIENDVKLEKGTKTDPAVWMDRLSAIFRHINLTVRNGEIHPCQPVITEIWPVLSSVCSKYQANSHVMERCCRCLRFAVRCVGKQSVNLLEPLVKQIVNLYSQHQHSCFLYLGSILVDEYASEPGCIQGLIDMLQAFIHPTFTILQGEAGLKLHPDTVDDLFRLCARFLQRAPIPFLTSPAINSILECALSCIPLDHRDANSSVMKFFYDLIHAGRTDEDHEDFSLRQRLVQNIILERGADIANNLLTASVFYLQIYMLSDVADVLMELILLDKQSAGNWIEQSLKRMPTHNSTGSVTATPKQMEDFHRSLLSASSSKALTTTLKEFTRLYR

SEQ ID NO: 12367 - protein, 498 aa, Euschistus heros
MAQRFPPTQPTPSPVQQPQRYPSPSGPPLRQYATPTFPLQQRPGGFVQGGGMGSGMMPRPQQQPYNPIRPPIPQSQKRPSDVRPPQQQPKGEFPHTSAGGSSGKKKKKLADKILPQKVRDLVPESQAYMDLLAFERKLDSTIMRKRLDIQEALKRPMKQKRKLRIFISNTFYPAKEATETEEGSVASWELRVEGRLLEDSKNDPNKPPPLQVKRKFSSFFKSLVIELDKELYGPDNHLVEWHRTPTTQETDGFQVKRPGDKNVRCTILLLLDYQPLQFKLDTRLARLLGVHTQTRPVIISALWQYIKTHKLQDPHEREYINCDKYLEQTFSCPRMKFAEIPQRLNPLLHPPDPIVINHIISVEGTEQKQTACYDIDVEVDDTLKTQMNNFLLSTASQQEIQSLDNKIHETVETINQLKTNREFFLSFAKDPQQFINKWIISQTRDLKTMTDVVGNPEEERRAEFYYQNWAQEAVCRYFYTKVQQKRAELEQALGIRNT

SEQ ID NO: 12368 - protein, 144 aa, Euschistus heros; identical to SEQ ID NO: 12255

SEQ ID NO: 12369 - protein, 342 aa, Euschistus heros
MKVLLESDVQLTTHFWAASDYKDKLSVAIGEPLVLSSDASWANHILLGHPAMPTATGHSGVIPSNEECGIRDVWAHNLKDEFKVIRKIIHKYNYVAMDTEFPGVVARPIGEFRSTADYQYQLLRCNVDLLRIIQLGLTFLDENGKAPAGPYSTWQFNFKFNLAEDMYAQDSIDLLQNSGIQFKKHEEDGIDPVDFAELLMTSGIVLMENIKWLSFHSGYDFGYLLKLLTNQNLPNDESEFFELLKIYFPTVYDVKYLMKSCKNLKGGLQEVADQLELTRVGPQHQAGSDSLLTGMAFFKMREMFFEDNIDDGKYCGHLYGLGASFVVNGNSFHDNGDNSSNS

SEQ ID NO: 12370 - protein, 401 aa, Euschistus heros
MSESRRVQLKEDLSFVEFETSENVEVISSFQSMGLKEDLLRGIYAYGFEKPSAIQQRAIIPIVRGRDVIAQAQSGTGKTATFAIAILQSLDTQTRDTQVLCLSPTRELAVQIQKVILALGDLMNVQCHACIGGTSLGEDIRKLDYGQHVVSGTPGRVFDMIKRRTLRTRSIKVLVLDEADEMLNKGFKEQIYDVYRFLPPATQVVLISATLPHEILEMTSKFMTDPIRILVKRDELTLEGIKQFFVAVEREEWKFDTLCDLYDTLTITQAVIFCNTRRKVDWLTEKMRDANFTVCSMHGDMPQKERDAIMKEFRSGKSRVLITTDVWARGIDVQQVSLVINYDLPNNRELYIHRIGRSGRFGRKGVAINFVKSDDIRILRDIEQYYSTQIDEMPMNVADLI

SEQ ID NO: 12371 - protein, 532 aa, Euschistus heros
MKNAAGDGHRSHSNVYKDKSKPQDVRSSNMTAAKGLADAIRTSLGPKGMDKMIQKGNGEVTITNDGATILQQMNVTHPAAKLLVELSQAQDVEAGDGTTTVVILAGAIMEAAEKLMNRGIHPTTISDAFSIAVEKALPILREMSIPLQQNDNESLIRSASTSLNSKVVSQHSSILAPLAVNAVLRITDPKKDKNVDLKDIKIIKKLGGTVEDTELIEGLVFTQKLANINGPKRLEKVKIGLIQFCISPPKTDMDHNVVISDYAAMDRILKEERAYILNIAKQIKKAGCTMLLIQKSILRDALSDLAIHFFDKLKIMVVKDIEREDIDFVCKTLGCRPIASLDHFTSEALVSAELAEEVSAGSSRIVKVTGIHNPAKTVTILVRGSNNLVLEEADRSIHDALCVIRCLIRERALLPGGGAPEIELSLRLGQHAQVLASVEAYCLREYAKALEIVPYTLAENAGLNPVATVTELRNKHVHGQTSAGINVRKGQVTDILEENVLQPMLVTASAITLATETVRSILKIDDILNVAH

SEQ ID NO: 12372 - protein, 415 aa, Euschistus heros
MEEIGIVLPEKEENSQDGKLSTILGQNLSDDSDSSDLFTKFKKLQRQLEFLAVQEEYIKDEQRNLKKEYLHAQEEVKRIQSVPLVIGQFLEAVDQNTGIVGSTTGSNYYVRILSTIDRELLKPSASVALHKHSNALVDVLPPEADSSISMLQADEKPDVQYSDIGGMDMQKQEIREAVELPLTHFELYRQIGIDPPRGVLMYGPPGCGKTMLAKAVAHHTTAAFIRVVGSEFVQKYLGEGPRMVRDVFRLAKENAPAIIFIDEIDAIATKRFDAQTGADREVQRILLELLNQMDGFDQTTNVKVIMATNRADTLDPALLRPGRLDRKIEFPLPDRRQKRLVFSTITAKMNLSEEVDLEDYVARPDRVSGADINAICQEAGMHAVRENRYIVLAKDFEKGYKNNIKKDESEHEFYK

SEQ ID NO: 12373 - protein, 172 aa, Euschistus heros
MPNIKLQSSDGEIFEVDVEIAKCSVTIKTMLEDLGMDEDEEEVVPLPNVNSAILKKVIQWATYHKDDPPPPEDDENKEKRTDDISSWDADFLKVDQGTLFELILAANYLDIKGLLDVTCKTVANMIKGKTPEEIRKTFNIKNDFSAAEEEQVRKENEWCEEKYLPTVTFLPQ

SEQ ID NO: 12374 - protein, 309 aa, Euschistus heros; identical to SEQ ID NO: 12261

SEQ ID NO: 12375 - protein, 316 aa, Euschistus heros
LVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGAKKRKKKNYSTPKKIKHKKKKVKLAVLKYYKVDENGKISRLRRECPSEQCGAGVFMAAMEDRHYCGKCAYTLVFNKPEDK

SEQ ID NO: 12376 - protein, 542 aa, Euschistus heros
MQPQIILLKEGTESSQGKPQLVSNINACQIIADAIRTTLGPRGMDKLIVDGGGKATISNDGATILKHLDIVHPAAKCLVDIAKSQDAEVGDGTTSVVLITSEILKQLKPYVDEGVHPRIMMKAVRKATQLCLDKINSLAVKIEKSSAEQHRSLLERCAATALSSKLIHQQKDFFSKMVVDAVLLLDELLPLDLIGIKKVPGGALEESLLVSGVAFKKTFSYAGFEMQPKKYTNPKIAILNIELELKAERDNAEIRLDNVEEYQKVVDVEWQILYEKLDTIVKSGAQVVLSKLPIGDVATQYFADRDMFCAGRVADEDIRRTQKACGGTMITTTKDMSSSVLGSCELFEEKQIGGDRYNFFSGCPNAKTCTMILRGGAEQFLEETERSLHDAIMIVRRTIKNDAVVAGGGAIELELSKMLRDYSRTIAGKEQLLIGAVAKALEIIPRQLCDNAGFDATAILNRLRQKHAQGSCWEGVDVTLEDISDNMEKCVWEPSVVKRNALEAACEAVCLILSVDETIKNPKSGGGGQGDQPMMPPRGRPM

SEQ ID NO: 12377 - protein, 4654 aa, Euschistus heros
MMTDSLESNDPPPEEQPVSIIDITDFLDYLRENIKLNLLGVKSVPSSLDSALDDNGNLDCIKKFLSDPQFATLIVQKNSTKDDDPEQGGEGEDEKETPTITISNMVQFCSPKASSLLFMKNGAIMDADKSIQSQLHMIEFSEGTAYESLHAIVSKGMSPYFKSYVKESGRADRDGDKMVPSVEKKIDELEMGLLHLQQNIDIPEITLVVHPIVSNVIKKCAEEGRKPKVADFGDRVEDSTFLNQLQHGVNRWIKEIQKVTKLDRDPASGTALQEISFWLNLERALHRIQEKRESIEVGLTLEILKHGKRFHATVSFDTDTGLKQALATVNDYNPLMKDFPINDLLSATELDRIKLAVQQIFTHLRKIRNTKYPMIRGLRLIEAISRDLTTQLLKVLGTRRLMHIPFDEFEKVMAQCISVFVTWDDEYEKLQNLLRDIVKKKRDEQLKMVWRVMPAHKKLQTRMEQMRKFRHQHEQLRTVILRVLRPVPASLINGQEVTGQDKVVDDAPNISAVEEVNLAYENVKEVDCLDMSKEGGEAWEAAVARYEEKIDKVETRITAHLRDQLGQAKNANEMFRIFSRFNALFVRQHIRGAIREYQTQLIQRVKDDIEALHEKFKVQYGQSKGCRMSSIRDLAPVSGSIIWVKQIDRQLTTYLRRVEDVLGKGWENHIEGQALKSDGDSFRLKLNTQEIFDDWSRSVQQRNLSVSGRIFAIESTRSRSGRGNLLKLKVNFLPEIITLYKEVRNLKNLGFRVPLAIVNKAHQANQLYPFAVSLIESVRTYERTLEKLDDKASIIPLVAGLRKEMQQLVAEGIQLVWESYKLEQYVHRFAEQVCTFQEKVEDLLVVEEQLDVDVRSLETCPYSASTLRDILAKVQHAVDDLSLKQYSNLHIWVSRLDQAVEKNLGGRLQAGIDAWTDALEGKSHELDLSMDTDAPARPTHAPGGDPHVQTVTHEVRITNQIMYLYPSIEEARFQIMQQLFQWQAVVTSQQRLQSSRYQLGLERLMSQSYRDLLTKLPNGSQALINAYDSIDRKIKDVVNYVDEWLRYQSLWDLQSDTLYSRLGDDITMWMRCLSDVKKSRTTFDTSETRRQFGPIAIDYAKVQSKVALKYDSLDKEILAKFGGLLGQDMSGFHSQISKSRSELEQQSIEAASTSDAVCFITYVQSLKRNMKSWQKQVEIYREGQRILERQRFQFPNNWLHVDNVEGEWSAFNEIIKRKDLSIQAQVVSLQQKMVAEDRAVEARTNDLLSDWEHSKPIEGRLRPDEALAQLNEFEVKFARLKEERDNVAKAKEALELQYTGASSGSEERVAVVFEEMEDLKEVWTELSGIWRRLDETREIPWLSVQPRKLRQQLDGLSQQLKELPARVRQYSSYEYVKKLLQGYTKVNMLIVELKSDALKERHWRALMRKLRVNWVLSELSLGQVWDVDLQANESVVKDIILTAQGEMALEEFLRQVRESWQNYQLDLINYQNKCRLIRGWDDLFTKVKEHINSVAAMKLSPYYKVFEEEALTWEEKLNRINALFDVWIDVQRRWVYLEGIFSGSADIKTLLPIETSRFHNISSDFLGLMKKVAKSPMVMDVLNIQGVQRSLERLADLLEKIQKALGEYLERERMSFPRFYFVGDEDLLEIIGNSKNIARLQKHFKKMFAGVASILLNEDNTIITGIASREGEEVIFTNPVSTVDHPKINEWLSLVEKEMRLTLAATLVSAVGELRAFKDAPLEPSNYMAWVDRYQGQIAVLAAQVLWSEDVEAALSGKSGGLQGVLTQVEGTLTVLADCVLHKQPPLRRRKLEALINEFVHKRTVTRRLIQANISSPKSFEWLCQMRFYLDPTQTEALSQLSIHMANAKFYYGFEYLGVQDRLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQIQTIQEALKYHMDSNNRDSTLTVELVGKQVRVSPDMAIFITMNPGYAGRSNLPDNLKKLFRSLAMTKPDRQLIAEVMLFSQGFRSAEKLASKIVPFFKLCDEQLSNQSHYDFGLRALKSVLVSAGNVKRDRIQRIKEKREGGSGDEATIAENLPEQEILIQSVCETMVPKLVAEDIPLLFSLLNDVFPQVQYTRAEMTKLKEEIRKVCQEEYLVCGEGDEQGGPWMEKYMGETWIEKVLQLYQISNLNHGLMMVGPSGSGKSSAWRVLLKALERFEGTEGVAHVIDPKAMSKEALYGVLDPNTREWTDGLFTHVLRKIIDNVRGEINKRQWIIFDGDVDPEWVENLNSVLDDNKLLTLPNGERLSLPPNVRVMFEVQDLKYATLATVSRCGMVWFSEDVLSTEMIFENYLSRLRHIPLEEAEEESSFPQLKKIGGERKEEGISPAMQVQTDVANILQSYFSPDGLVVRCLEYALKQEHIMDLTRLRALGSLFSMLNHGVRTVIQYNQSHSDFPLPSEQLDRFIPKILIYSLLWSFGGDAKLKVRSDLGDFIRSVTTIPLPPNNPNIPIIDYEVNISGEWSPWSAKVPQIEVETHKVAAPDVVVPTLDTVRHESLLYTWLAEHRPLVLCGPPGSGKTMTLFSALRALPDMEVVGLNFSSATTPELLLKTFDHYCEYRKTPNGVVLAPVQLGKWLVLFCDEINLPDMDSYGTQRVISFLRQLVEQRGFYRSSDLAWVSLERIQFVGACNPPTDPGRKPLSHRFLRHVPVIYVDYPGETSLKQIYGTFSRAMLRLIPSLRGYAEPLTNAMVEFYLSSQERFTQDMQPHYVYSPREMTRWVRGICEAIRPLDSLKVEGLVRLWAHEALRLFQDRLVEASEREWTNENIDKVALKHFPSVDKESSLGRPILYSNWLSKDYIPVERDQLRDYVKARLKVFYDEELDVPLVLFDEVLEHVLRIDRIFRQPQGHLLLIGVSGAGKTTLSRFVAFMNGLSVFQIRVHNKYTSEDFDEDLRSVLRRSGCKNEKIAFILDESNVLESGFLERMNTLLANGEVPGLFEGDEYSTLMTQCKEGAQREGLMLDSNEELYKWFTGQVMRNLHVVFTMNPSHEGLKDRAATSPALFNRCVLNWFGDWSDGALYQVGREFTNTLDLDGPPTWKAPDFFPIAYANLPSPPNHRQAVINGCVFVHQTLHKANQRLAKRGARTMAITPRHYLDFINHFVKLYREKCSELEEQQLHLNVGLGKIAETVEQVEEMQKSLAVKSQELQAKNEAANAKLKQMVKDQQEAEKKKVQSQEIQSQIEKQKLLIAQKREGVMADLAQVEPAVIDAQQAVKEIKKQQLVEVRSMANPPAVVKLALESICLLLGESATDWKSIRAVVMRDNFINSIVNNFSTENISDEVREKMHTRYLSNPEYTFEKVNRASMACGPMVKWAVAQISYADMLKKVEPLREELRSLEEQAGENEQKGEDTKALIAQLEKSIAAYKEEYAQLIQEGLAIKQDLENVQAKVDRSIALLKSLGLERSRWEATSETFKSQMATIIGDVLLSSAYLAYAGYFDQHSRHNLLSRWTEHLSSAGIQYRQDIALTEYLSNPDERLRWQANSLPTDDLCTENAIMLKRFNRYPLIIDPSGQATEFIMNEYRDKITKTSFLDDSFRKNLESALRFGNPLLVQDVENYDPILNPVLNREVRRTGGRVLISLGDQDIDLSPSFVIFLSTRDPTVEFPPDICSRVTFVNFTVTRSSLQSQCLNQVLKAERSDIDEKRSDLLKLQGEFHLRLRQLEKSLLGALNEAKGKILDDDSVITTLETLKQEAAEISKKVEETDRVIGEIETVSQQYKPLSQACSNMYFTLDSLHQIHFLYQYSLKFFLDIFSAVLFSNPSLDGLTDHTQRLGVITKQLFAVCYERVARGMLHTDRLTLALLLSRIYLRGLPQEDQLEAEFHHFLRGKEGVIVSGGGASHLEGLSSDQLEALIRLGNRLPQFKELMKKVNEMPEFVAWLQQSTPEQNVPTLWHEDKPLSPIATAMNRLLLIQAVRGDRVTAAGAGLVSAVLGEGFTARAERELDLAHIVESEMTAGVPVLLCSVPGFDATSRVDDLAAESGKQLASIAIGSAEGFSQADSIINMAVRSGRWVLLKNVHLAPQWLVQLEKKLHSLQPHSGFRLFLTMEINPKVPVNLLRAGRIFVFEPPPGIRANLLRTFSTVPASRMMKAPSERARLYFLLAWFNAIVQERLRYAPLGWAKHYEFNESDLRVACDTLDTWIDATAVGRTQLPPEKVPWDALVTLLSQCIYGGKIDNDFDQRLLSSFLSKLFTPRSFEADFALVANVDAGAPGGQRHITMPDGTRRDHFLHWIESLADRQTPSWLGLPNNAEKVLLTNKGTDLVIKLLKMQQLEDEDELAYTEQESGPPSSLQPGPDPGRPAWMRTLHNSALTWLQLLPTNLQTLKRTVENIKDPLYRYFEREVNSGAKLLRDVIHDLTDVVAICQGEKKQTNYHRTMLSDLVRGILPSGWRRYTVPRGCTVIQWITDFSNRVKQLDTISQLASQRGPSEIKNTPIWLGGLMNPEAYITATRQCIAQANSWSLEELILDVTIPEPSSTSSVATDECSFSVTGLKLQGAQCRNNQLLLTSTIMMDLPTTLLRWHRAGGEGDSGKLSLPVYLNSTRSELLFTVDLNIAPGQEPHSFYERGVALLTSTALN

SEQ ID NO: 12378 - protein, 879 aa, Euschistus heros
MADSSTDSSDSEEDRKQRDEFAARLRKKDKENMRKITTIHSDKRAYEEAAKRLKIDSEHQEKLIPRLRVESRRKYLEKRKEDKVLELEADIIDDEYLFNDDELTERERKDRDHKKKLLVLAKEHEKARELEKVQRYHMPRDVKEGVEQYEEVDERENKPNYEQRKWEEEQMSSAVFHFGAKQKDKYQEEYDLVLDNQIEFIQAMSLAGTKEKPDQQLTEKERKRLTIEETQKSLPVFKFKDELVQAIKDHQILIIEGETGSGKTTQIPQYLYQAGFTKDGKKIGCTQPRRVAAMSVAARVAEEMSVKLGNEVGYSIRFEDCTSERTVIKYMTDGTLHREFLSEPDLQTYSVMIIDEAHERTLHTDILFGLVKDIARFRSDLKLLISSATLDAEKFSTFFDDAPIFRIPGRRFPVDIYYTKAPEADYIDACVVSILQIHATQPLGDILVFLTGQEEIETCQEILQDRVRRLGSRIKELLILPVYSNLPSDMQAKIFQPTPPNARKVVLATNIAETSLTIDNIIYVIDPGFCKQNNFNSRTGMESLIVVPVSKASANQRAGRAGRVAAGKCFRLYTAWAYKHELEDNTVPEIQRMNLGNVVLTLKALGINDLINFDFLDPPPHETLVLALEQLYALGALNHHGELTKLGRRMAEFPLDPMMGKMLLASEKYKCSEEIVTIAAMLSVNGAIFYRPKDKVVHADTARKNFFLPGGDHLVLWNVYKQWADTDFSTQWCYENYIQYRSMKRARDVREQLVGLMQRVEMDFISNPTDTIAIRKTITSGYFYHIARLSKGGHYKTVKHNQTVMIHPNSCLFEDLPRWVVYHELVFTTKEFMRQVAEIESKWLLEVAPHYYKPRELEDSTNTKMPKVLGKTRAQLGEH

SEQ ID NO: 12379 - protein, 456 aa, Euschistus heros
MKIEEVKSTVKTQRISSHSHIKGLGLDENGIPIQMAAGLVGQENAREAAGIVVEMIKSKKMAGRAVLMAGPPGTGKTAIALAMAQELGNKVPFCPMVGSEVFSSEIKKTEVLMENFRRAIGLRIKETKEVYEGEVTELTPVETENPMGGYGKSVSHVVIGLKTAKGTKQLKLDPSIHESLTKEKVEVGDVIYIEANSGAVKRQGRSDTYATEYDLEAEEYVPLPKGDVHKKKEVIQDVTLHDLDVANARPQGGQDVLSIMGQLIKSKKTEITDKLRAEINKVVNRYIDQGIAELVPGVLFIDEVHMLDIETFTYLHQALESAIAPIVVFATNRGRCQVRGAVDIISPHGLPLDLLDRLLIIRTAPYSQPEMCQILKLRAVTEGLSIDEDALSELSDIGSKTTLRYAVQLLTPSNLTAKVNGRSTITREDVAEVGQLFLDAKSSAKILAKHQDQYMK

SEQ ID NO: 12380 - protein, 731 aa, Euschistus heros
MTSIIKFHALSGVMDESPPCYILQVDEFRFLLDCGWDEHFNQDYIKELKRHVHLIDAVLLTYPDHLHLGALPYLVGKCGLSCPVYATIPVYKMGQMFMYDLYQSRYNMEDFNVFSLDDVDAAFDKVVQLKYNQSVTMKGKCYGLSIVPMPAGHMIGGTMWKIMKTGEEDIIYAIDFNHKKERHLNGCDLERLQRPSLLITDAFNATYQQERRRARDEKLMTTILQTLSSNGNILIAVDTAGRLLELAHMLDQLWRNKNSGLQIHPLCLINNVSYNVVEFAKSQIEWMSDKLMKSFEAVRNNPFQFKHIRLCHSVSELNKIPSAKVVLASMPDLECGFAREIFFQWASDSKNSIVLTSRCCEGTLARDLLDNGVGRTIQITVKKRVRLEGEELKEYLKAHKKTNDKNEEKESSESEDEIQLLSVTKGSHDLVIKQERRKKNQKSLKKFYPMFPFIDRKVKFDEYGEFVRIEDYKAPDATKRPPEKKSKKKDDDVLDPADIPTKCVSYEKSLTVNAQVQYIDFEGRSDGESVQKIITQLRPRRVILVRGTSENTEALEKHLLQWSEAKIFCPKKGDIVDATTESHIYQIRLTDSLVSSLHMQKGKDSELAWIDAITKYRQKPSDTMQSAEEMEVEDDGNYSIYNDDYLTLEPLPLTEVNPHQAVFINELKLSDLKQILSRNGIESEFSGGVLWCCNGTIAIRRLESSKVYLEGWISENYYRIREILYGQYAIL

SEQ ID NO: 12381 - protein, 807 aa, Euschistus heros
MPSIDVIQPPPPPPSMEKEEPILQPTTKPIVGIIYPPPEVRNIVDKTASFVARNGPEFESRIRQNELGNPKFNFLNTGDPYHAYYQHKVKEFKDGKGAEPPPPPAPVQQKTVASATQLKQQEILKQVTEQPFVPKDPPPDYEFMADPPSISALDLDIVKLTAQFVARNGRQFLTNLMNREQRNYQFDFLRPQHSLFLYFTKLLEQYTKVLIPPKDLMSRLKEECSNPTGVLEQVRYRADWLHYQELQKRKEEQALEKERVAYAQIDWHDFVVVETVDYIPGEVGNFPPPTTPDEVGARVLMQERILENGGEDLTEGAGSDEEREKEDSEREEATGDKGDNTQVQDMEEESSSDSDDDDERDQSLGEKQPATQAQKQQMLQQNQQLASADGKKPSTQPSMQPPLPPAPDKVIVKKGYNPKQNQKISKGADNYLISPLTSEKIPANKVQEHMRIGLLDPRWVEQRDKHIQDRINQETVYAGGSAIEASLKQLAERRTDIFGVGDEETAIGKKIGEEDKKKDDKVTWDGHTSSVEAATRAARANITIEEQIHQIHKVKGLLPDEEKEKIGPKPVPGSVSTSSANPMIGGPPIVVQAKAPPLPPPPKVPPLPPPAPLPPPPGLVPQPPIMMVPAPLRPPLMVPPGAFPVVAATPPAFMAPPGTAPLPPAPQPPPQVTQVGNLLKHVASAAAGETEDEPMTKKAKTEDCLIPEAQFLMQNKSPVTFKVVVPLLADKPEWKLNGQALTFTLPLTDTIASVKSNISETIGMPAAKQKLQCDGIFYKDSNSLAFYNISPATVVYLQLKERGGRKK

SEQ ID NO: 12382 - protein, 313 aa, Euschistus heros
MPGVELVTNKVVVHPLVLLSVVDHFNRMGKIGNQKRVVGVLLGCWKAKGVLDVSNSFAVPFDEDDKDKSVWFLDHDYLENMYGMFKKVNAREKVVGWYHTGPKLHQNDVAINELIRRYCPNSVLVIIDAKPKDLGLPTEAYRAVEEVHDDGSPTTKTFEHVPSEIGAEEAEEVGVEHLLRDIKDTTVGSLSQRVTNQFLGLKGLNQQIQDIRDYLMQVVEGKLPINHQIIYQLQDIFNLLPDMNHGNFVDSLYIKTNDQMLVVYLAALVRAIVALHNLINNKLSNRDAEKKESTKKEEKPKEEETVKKELKAK

SEQ ID NO: 12383 - protein, 540 aa, Euschistus heros
MFQPIFVLSQNSKRESGNKVRSENIAAAKMIAEVIRTCLGPQAMLKMLMDPMGGIVMTNDGNAILREITVQHPAAKMIIEIARTQDEEVGDGTTSVVILCGQIMAEIERHIDEVHPTTIIKEFKRALDDILKILPDISTSLDLKDKSKVIEVVKGCLGTKFLGTWSEMACQMAIDAVDTVRDLKGHGIDLKNFAKIEKVPGGFIEDSKVLEGVMLNKDVTHPKMSRFIKNPRILLLDCSLEYKKGESQTNVEIIKEGDYTRLLQIEEEYIEKMCNHIIEQKPNVVITEKGVSDLAQHHLFKAGITTIRRVKKTDNNRIARAVDATIVSRVEEIKPYHIGCGAGLFEVKKIGDEYFTFITECKNPKACTILLRGPSKDVLNEVQRNLQDAMNVVRNLYLDPRILPGGGAVEMALHRALIKANFTVDMDEDCYAAIPSALRIIPRTLLQNAGGKVIRSMNELEKQHNSGVLKGVDGITGELKTVDELGVWEPYSVKVQIYKTAIESAILLLKIDDIVSGAKNKDRERNSGPIAQPSEESLKE

SEQ ID NO: 12384 - protein, 272 aa, Euschistus heros
TVVYQIGHCDLSHILSRKVIFENVGHSLGDLVVYQELVFTMAMPRTYGGLSDYRNVPAPSFSPYSENGGSVVAVAGDDFAIIASDTRLSTGFQIYTRNQSKLFKLSDKTILGSTGCWCDVLSLTRLVQTRIKMYQYDHNKVMSTPAVAQMLSVLLYYKRFFPYYVANILAGIDDNGKGVVYSYDPIGHHESSKFRAGGTAGALLQPLLDNQLGMLNQENVQDKTYTLEKAHAIVKDVFISAAERDIFTGDRISINILTKDGIREDSFELRKD

SEQ ID NO: 12385 - protein, 299 aa, Euschistus heros
MFGFSMFPFPPRPFKVQYYCFSVAMIPGNERDDVERGGKIIMPPSALDHLTRLNINYPMLFKLHNSKTNRTSHSGVLEFVADEGKVYLPHWMMRNLMLEEGDVIEIESVSLPVATFSRFQPQSPDFLDISNPKAVLENCLRNFACLTTGDIINIKYNQKDYELSVLETQPGAAVTIIECDMNVEFAPPLGYKEPNSEQEALDESSERSENLTNEGSGFIPFFGEGYRLDGKQKKAIEDESVGFKIPTVRGIPDYDWKVGVITFMRNVRQPVKEAQKDDEDKFQPFYGQGHVLSTNRNRK

SEQ ID NO: 12386 - protein, 542 aa, Euschistus heros
MAAFPGSIAFDEYGRPFIIIKDQDKQKRLTGNDAIKSHILSAKAISKIVRTSLGPKGLDKLLVSQDGDVMVSNDGATIMKQMDVDNEIAKLMVQLSQSQDDEIGDGTTGVVVLAGALLEQADILLDKGIHPIRIADGFELAARAAIQHLDSIATKFPVDPNNLEPLIKTAMTTLGSKIVNKCHRQMAEIAVKAVLSVADLEKRDVNFELIKVDGKVGGRLEDSMLVKGVVIDKDFSHPQMPKVLKDVKIAILTCPFEPPKPKTKHKLDVTSIDDYRALRKYEEEKFNTMVSQVKDAGATLAICQWGFDDEANHLLLKRELPAVRWVGGPEIELIAIATGGRIVPRFEELSPEKLGRAGLVREISFGTTKDKMLVIEECANSRSVTIFIRGSNQMIIDEAKRSMHDALCVVRNLICDDSIVYGGGAAELSCSIATAKQADKISSIEQYAFRAFSEALESIPFALAENSGLPPMQVVTHVRGRQIQENNPALGVDCMGKGTNDMKEQHVIETLKSKKQQIMLATQLVKMILKIDDVRTPNDIQF

SEQ ID NO: 12387 - protein, 113 aa, Euschistus heros; identical to SEQ ID NO: 12274

SEQ ID NO: 12388 - protein, 534 aa, Euschistus heros
MVSLNPIRILKHEAEEEKGEMARLSNFIGAIAVGDLVKSTLGPKGMDKILVSYGRNRGNIEVTNDGATILKSVGFDNPAAKILVNMSKVQDDEVGDGTTSVTVLAAELLREAERLIERKIHPQTIIGGYRRATNVALAALDKCAVDNSSNDAEFAEDLLKIARTSLSSKILNLHTEKFSKLAVDAVLRLKGSGNLSAIQIIKKTGGSLDDSFLDDGFLLDKKVGQFQPKRVENAKILIANTPLDTDKIKVFGSRIRVDSLAKVADLELAEKEKMKEKIDRIISHKCNVFVNRQLIYNYPEQLFADAGIMAIEHADFDGIERLALVTGGEIVSTFDTPELVKLGECDLIEEIMIGEDKLLRFSGVKLGEACSIVIRGATQQIVDEAERSLHDALCVLVTTVRDKKTVFGGGCSEIIMASAVSDDAINVTGKEAVAMESFAKALLELPTTISDNGGFDSAYLVTALRAAHNKGQITYGLDMKNGGVACMRELGIVESHSVKRQMLLSASEATEVILRVDDILKAAPRKRTEDRGYC

SEQ ID NO: 12389 - protein, 277 aa, Euschistus heros
MFRNQYDSDVTVWSPQGRLHQVEYAMEAVKLGAATVGVKNKQFAVLVALKRASSELSAHQKKIIPLDNHIGMSISGLTADARILSRQMRSECLSYSYSYGTEIPIIRLMNKISNMMQSSTQRYDRRPYGVGLLVAGYDGDGPHIFQICPSANLYECRSMAIGARSQSARTYLEKHLVDISNSPTLTDLLKHALRALRDSSPNDTELSSKNVAIAVVGKDTPLKELSEADTQTYLDMILSEERRSGDTGGASDDAPPPPPPSDPPAQDPTPVVAMETQ

SEQ ID NO: 12390 - protein, 845 aa, Euschistus heros
MPIYQHKIVINEEDLPYEEEILRNPFSIKHWLRYIEFKKDAPKNGVNIIYERALKELPGSYKLWYNYLILRKRQIKGRCITDPSFEHLNNTYERSLVFMNKMPRIWMEYCQFLVDQCKITKARHVFDRSLRALPITQHHRIWPLYIKFLKKHNIPETAVRVFRRYLKLCPEDTEEYIDYLTAISRLDEAAVRLADIVNTDDFVSKHGKSNHQLWTELCDLISKNPQEVRSLNVDAIIRSGLKKYTDQLGHLWNSLADYYIRSGLFEKARDIYEEAIQTVTTVRDFTQVFDAYAQFEELSLSKKMEEVSQKAFPTDDDDIDIELRLARFEDLIERRLLLLNSVLLRQNPHNVHEWLKRVQLFEGKPHDIIYTYTEAVQTVDPKLAVGKPHMLYVNFAKFYEENGQVEDSRIVLEKGTQVPYTKVEDLASVWCEWAEMEIRNENCDEALKILQRATVMPARKVDYHDDSETVQMRLYKSLKIWSLYADLEESFGTFKSCKSVYDRIIDLKIATPQIIINYGLFLEEHNYFEEAFRTYEKGIALFKWPNVFDVWNTYLTKFLKRYGGSKLERTRDLFEQCLENCPPKYAKGFYLLYAKLEEEHGLARHAMAVYERATSAVLPEEMFEVFNIYIKKAAEIYGVPKTRQIYEKAIEVLGEDNSREMCLRFAEMETKLGEIDRARAIYAHCSQMCDPRVTSTFWQTWKDFEVRHGNEDTMREMLRIKRSVQATYNTQVNMMSAQMLSAASNVSGTVADLAPGAKDGMRMLEAKAAEMTVTTKSGSSAIMFVRGETQNTPQEVQKEIINPEALNVDSDDDDDENLEDDDLPIEKQIIPDEVFCGLKKGSDSD

SEQ ID NO: 12391 - protein, 329 aa, Euschistus heros; identical to SEQ ID NO: 12278

SEQ ID NO: 12392 - protein, 258 aa, Euschistus heros
MGRVIRAQRKGAGSVFRSHTKHRKGAPKLRSLDFAERHGYIKGVVKDIIHDPGRGAPLAVVHFRDPYRFKTRKELFIAPEGIYTGQFLYCGKKANLHVGNVMPVGGMPEGTIICNLEEKTGDRGRLARASGNYAIVIAHNPDSRRTRVKLPSGAKKVIPSNNRAMVGIVAGGGRIDKPVLKAGRAYYKYKAKRNCWPKVRGVAMNPVEHPHGGGNHQHIGKASTVKRGTSAGRKVGLIAARRTGRIRGGKTDQKKGED

SEQ ID NO: 12393 - protein, 136 aa, Euschistus heros [sequence omitted]

SEQ ID NO: 12394 - protein, 531 aa, Euschistus heros
MAAITLLNPKAEVVRKTEALSMNQSAAKGLQDVMKTNLGPRGTMKMLVSGAGDIKITKDGNVLLKEMQIQHPTASLIARTSTAMDDITGDGTTSTVLLIAELLKKADSYIIEGVHPRLITEGFTVACKHAMEVLDKMKKTVSLDDKETLLSVARTALNTKVESKVAEVLTQICVEAVQAIKLPEKPLDLHMVEIMTMQSRLESETRLVRGLVLDHGSRHPNMPKKLTNAFILTCNVSLEFEKTEINSGFFYKSAEEREKLVASEREFIELRVKKIIALKKSVCDGTDKGFVVINQKGIDPVSLDLLAREGIMALRRAKRRNMERLTLACGGVAMNSLDDLTEECLGRAGLVYEHVLGETKYTFVTDCPNPHSVTVLVHGPTSYAITQIQDALRDGLRAVKNAVEDGGVLPGGGAVELKIRHELKKVAETTKEKYRVGIEAFCDALLIIPKTLAMNSGFNTQEVITQLDYDAKENDSIGLDLQSGKSMIPTDLGILDNYSVKKQYIASSIIVASNLLLVDEVMRAGMSSLKG

SEQ ID NO: 12395 - protein, 1047 aa, Euschistus heros
MSSAEVANNSIEPPAKKRKIATGETAPANSVSKAISAMANNGSFDSNQEIDEGLYSRQLYVLGHDAMRRMASSDVLISGLGGLGVEVAKNVILGGVKSVTLHDETLCTISDLSSQFYLSENSIGLNRAEASCQLLSELNHYVPTRAYTGPLTDEFIKEFSVVVLTNASEDEKLRISEIAHASDVSLIIASTVGVFAQVFCDFGREFTVVDTNGENPVSAMIASISRDEEGVIACLDDTRHGLEDGDYVTFSEIQGMTELNGCEPTKIKVLGPYTFSIGNTSKFGEYIRGGIVQQVKMPKVLQFKSYSEALKAPDFIATDFGKFDHPDQLHVAFKALDAYKKEFGKLPSPWNSKDASDFLNCCKTVMPDVRENLELNEKLMEQFSKTCSGNMNPIDAFIGGVVAQEVMKACSGKFHPIFQWLYFDCIELLPKEDLSPNDCAPTNSRYDGQVAIFGKEFQKTLGALKYFVVGAGAIGCELLKNFSMMGVGADGGKVIVTDMDLIEKSNLNRQFLFRPHDVQKPKSATAAKAIKKMNPLMNVIAHENRVGPETEKVYDDAFFEDLDGVANALDNVDARIYMDRRCVYYRKPLLESGTLGTKGNTQVVVPFLTESYSSSQDPPEKSIPICTLKNFPNAIEHTLQWARDVFEGLFRQSAENAALYLSDSNFIDRALRLPGVQPMEVLESIKQALIDDRPKSIDDCVAWARNHWQEQYSNQIRQLLFNFPPDQMTTNGQPFWSGPKRCPVPLVFDVNNDLHLDYIIAAANLKAEVYGIPQVRDRSVIAKIVQNVEVPEFTPKSGVKIAVTDSQMANGAGGQIDQDKIVQLYNELPSKEMFSDFNITPLEFEKDDDNNFHMDFIVAASNLRAANYNIPPADRHKSKLIAGKIIPAIATTTSVVAGLVCIELMKLAKGYNDIEMFKNGFANLALPFFGFSEPITAPKLKYYENEWTLWDRFEVTGEMTLKEFIDYFKDKHQLEITMLSQGVCMLYSFFMAKSKLEDRLNLPMSEVVRRVSKRKLEPHVKALVFELCCNDTDGNDVEVPYVRYTLP

SEQ ID NO: 12396 - protein, 425 aa, Euschistus heros; identical to SEQ ID NO: 12283

SEQ ID NO: 12397 - protein, 487 aa, Euschistus heros
MPVEAMQTDVEMKVVDSPSSEDPVASAVQEIREHIRQLEKAVANKEPRFILRVLRLLPSTRHKLSALVLRNVISSFYLNSPEKDALFLYIEDAMDSDTTQKTKLIKNSNTPLIPEIDAYIHLLVLVRLIDAGKESEAVKCSDALMAKITAQNRRSLDLVAAKCYFYHSRVYELTNQLEKIRGFLHARLRTATLRNDFEGQAVLINCLLRNYLHYKLYDQADKLVSKSVYPESASNNEWARFLYYLGRIKAARLEYSESHKHLVQALRKAPQHAAVGFRQTVQKLAVTVDLLLGDIPDRQIFRQAPLRRSLAPYLQLTQAVRTGDLQRFGEVLEMFGPQFRSDHTFTLILRLRHNVIKTAIRCIGLSYSRITPTSIASKLGLDSPEDAEFIVAKAIRDGVIEATLDPEHGYMQSNEVTDIYRTREPQLAYHQRISFCLDLHNQSVKAMRYPPKSYGKDLESAEERREREQQDLELAKEMAEEDDDVFP

SEQ ID NO: 12398 - protein, 586 aa, Euschistus heros
MALSTPSVPVSEILKSSADSDEPKKKSREDWRKAKELEEARKAGTAPAAVDEEGKDINPHIPQYISSAPWYYSARGPTLKHQRIQDESVKKYSGIDEWYKRGVDNSKVVTKYRKGACENCGALTHQKKDCMERPRKIGAKFTGAKIAPDEFVQPELSRDYDGKRDRWAGYDPSQHKMVIERYARIDEAKRQLRADKLNSEQSEEAEEEEAKDNIADEGGEDEDKYVDEVDMPGTKVDSKQRITVRNLRIREDTAKYLRNLDPNSAYYDPKTRSMRDNPYAGSADTDVDYAGENFVRFTGDTLEHARVQLFAWEAHNKGVDVHPLGEPTRLEVLKKEFVGKKEEFKQRGQEDLIKKYGGEEHLNAPPKELLLAQTEYYAEYTRYGTVIKGQEKEVVRSRYEEDVLINNHTTVWGSFWHSGKWGFKCCHSFIKGSYCTGEAGRLASSAGEVAVKGPAFIPPRPATPSASSSSSSSASSSSSSSSSEDEEEKERKKKKQEKKKAKKKKQKVKKLMNKNKKPEEKTEEEQLKDALKKEEEAQKEGERLMKLDDRKRPYNSMFEVQKPTDVEMEAYYMKKKRDEDPMANFL

SEQ ID NO: 12399 - protein, 208 aa, Euschistus heros
MGISRDHYHKRRKTGGKRKPIRKKRKYELGRPAANTKLGPKRVHLVRTRGGNTKFRALRLDYGNFSWGSECCTRKTRLIDVVYNASNNELVRTKTLVKNAIVVIDGTPFRQWYEAHYALPLGRKKNAKLSEAEEAVLYKKRSRKTENRYKARQKLAKVEPALEEQFQTGRILACLASRPGQCGRADGYILEGKELEFYLRKIKAKKGK

SEQ ID NO: 12400 - protein, 311 aa, Euschistus heros
MDRLLRLGGGMPGLSQAQPPSDAPVVDTAEQVYISSLALLKMLKHGRAGVPMEVMGLMLGEFVDDYTVRVIDVFAMPQTGTGVSVEAVDPVFQAKMLDMLKQTGRPEMVVGWYHSHPGFGCWLSGVDINTQQSFEALSERAVAVVVDPIQSVKGKVVIDAFRLINPNMMVLGQEPRQTTSNLGHLQKPSVQALIHGLNRHYYSISINYRKNELEQKMLLNLHKKSWMDGLMLSDYSENCKVNETTVGDMLELAKNYNKALEEEEKMTPEQLAIKNVGKQDPKRHLEEKVDVLMSANIVQCLGAMLDTVVFK

SEQ ID NO: 12401 - protein, 429 aa, Euschistus heros
MDSFLKTVGCYIHRPHHDKEVLVHGKANILEQMDVDEKKGEGFRSYYITKIEELQLIVAEKSQNLRRLQAQRNELNAKVRMLREELQLLQEQGSYVGEVVKPMDKKKVLVKVHPEGKFVVDIDKNIDINDVTPNSRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILRIHSRKMNLTRGINLRKIAELMPGASGAEVKGVCTEAGMYALRERRIHVTQEDFEMAVAKVMQKDSEKNMSIKKLWK

SEQ ID NO: 12402 - protein, 200 aa, Euschistus heros; identical to SEQ ID NO: 12289

SEQ ID NO: 12403 - protein, 249 aa, Euschistus heros
MFLTRSEYDRGVNTFSPEGRLFQVEYAIEAIKLGSTAIGVCTPEGVVMGAEKRIKSPLMEPEAVEKILQVDDHIGCAVSGLMADSRTLVEHARVQCLNHWFVYDEKMPIESAAQAVSNLAIRFGDADEDAGPAMSRPFGVAVMFGGYDYRGPQLYHMDPSGTFIYFDAKAIGSGSEGAQQRLQELYHKGMSLKEAIQMILTILKEVMEEKLTDNNVEIAVVTAEEKQFRMYTKEEVSKVIGETQSAPTS

SEQ ID NO: 12404 - protein, 388 aa, Euschistus heros
MSEYWLISAPGDKTCQQTWETMNNLTSKQHNLSENFKFHIPDLKVGTLDQLVGLSDDLGKLDNFVDQVTHKVAQYLGEVLEDQKDKLQENLMANNTDLSTYITKFQWDMAKYPIKQSLRNIADIISKQVNQIDADLKTKSTAYNNLKSSLQNMEKKQSASLLTRNLADLVKKEHFILDSEYLTTLLVVVPKSNFNDWNSSYEKLTNMIVPRSSQLVYQDSDFGLFTVSLFKKVVNDFKLMAREKKFVVRDFIYNEEELAAGKNEITKLVTDKKKQFGPLVRWLKVNFSECFCAWIHVKALRVFVESVLRYGLPVNFQAMLIHPHKKSVKRLRDLLNQLYAPLDSSAQQQGGQGGGNDSVDIPGLGFGQSDYYPYVYYKINIDMLDTKA

SEQ ID NO: 12405 - protein, 549 aa, Euschistus heros
MSTLGVPLSVGGTRTSGAPVRTQNVMAACSIANIVKSSLGPLGLDKMLVDDIGDVTVTNDGATILRLLEVDHPAARVLVDLAQLQDEEIGDGTTSVVIIAAELLRNADELVKQNIHPTSIISGYRLACKEAQKYIQEHLCVSVDELGKDSIINIAKTSLSSKVIGIDDDFFASMVVEAAQAVKVSDSKGKATYPIKAINILKAHGGSAKESILVNGYALNCTVASMGMIKRVENAKIACLDFSLQKTKMKLGVEVLVEDPNQLEAIRDREADITKDRIQKILSVGTNVVLLSGGIDDIYMKYFVEANAMVVRRVKKADLKRIAKATGASFATSLTNMEGEEAFDASLLGEAAEVSQERICDDELILVKSPKAHSAASIILRGPNDYFCDEMERSIHDSLCAVKRVLESKTVVAGGGAVEAALSIYLENFATSLSSREQLAIAEYAKSLLVIPKILAVNAALDSTDLVAKLRAYHNTSQTKKDHAHLKWHGLDLYGGAVRDNKKAGVLEPTISKIKSLKFATEAAITILRIDDLIRLEAEKKDQGHGDMH

SEQ ID NO: 12406 - protein, 258 aa, Euschistus heros
MLNIADASMAFEHSSLRSNNNTLDDHQVKIIKAPDFLTRTLYPMTTTASVVGIKFSNGVAIAADVGGYYGSLNRFKSLDRLYKVNNNIVMTTTGDYADFQYMRELIQQKVISEEILDDSFSLKASSLHTWLTRLMYNRRSKFDPLWNNVIVAGYDSNGPFLGIVDKLGMSYEDSCVATGMGGYLATPLLRDVHERSKGNLTKQEAHAALQKCMEILYYRDTQSLPKFQIATVTEEGVEISPEIELEGNWEIVKHSKGF

SEQ ID NO: 12407 - protein, 626 aa, Euschistus heros
MQFIETAREISHLEGEMYQLSHLLSEQRALLGSMSNSGAEPVLQAGGSKAQEEKRIAALSTVLEVIESCPDLLDTPGRELLHEGDLVELDPLENTALHRTRALLFSDMFMIATWMSERKGLAKYKFESNYDLGSLAVVNVRDLGQVKHAFKLLVFPDTRLFQCVNNEAREEWLKKFDEAKKARLNTDQTKKKDENEKESHPVHEHLTKPPDRTDSVEFGSNPFGFVLDDDGDSDALPEWLTEAADDLDVSIAQRHFEEAYAIIQKAEEYFASAQDDQSLADIKSKVENRKDVLISVLLSELNVSAEKSLQGGLRASRRAVRLLNQLNKSTQACELYLKVCTNLLKAQSKRVKREGATVAYVKRLSEVYFSNLASITSEFQYRAFPHNQDCTSAFVVWVSMEVSHFLSHIIKQVFIPQTPLGTLAECIDIIRKQSQQMCELGLDLSYQVNGQTMTAVTRAVAEAGEKAVDAVKVRAAEDPWRPSRQTQQSVNKIQSEIGLPVTEYLADDGVFELTANSLSFAKLLSSLTDEGLMISCQDLEFALGKALKEVLQAHLNHLSASYSSNKFNSQRSLIQQNAKFILDQLLESVQRKYNEKMGHRCKKLDTLRKEFNFILKESKTTITGYI

SEQ ID NO: 12408 - protein, 415 aa, Euschistus heros
LIILPVYSALPSEMQTRIFEAAPPGSRKVVIATNIAETSLTIHGIFYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLSKMLIMSVHLQCSDEILTVVSMLSVQNVFYRPKDKQALADQKKAKFNQAEGDHLTLLAVYNSWKNNKFSNAWCYENFVQIRTLKRAQDVRKQLLGIMDRHKLDVVSAGKNTVRVQKAVCSGFFRNAAKKDPQEGYRTLVDSQVVYIHPSSALFNRQPEWVIYHELVQTTKEYMREVTTIDPKWLVEFAPAFFKFSDPTKLSKFKKNQRLEPLYNKYEEPNAWRISRVRRRRN

SEQ ID NO: 12409 - protein, 415 aa, Euschistus heros
MAPTRKTEGLLARVNFPLYTLQMLTSRHVLVGGGGGSAKTGVANGFEIFELSYDGNRFSAEEVIRHETGPKVVMNSACYSDKKSTFLVAGQESHCQLYRVGITVEKEFSEEPMNGVVESPNLRHRKSSKNHQNGISETTKNSLRKKLAFKFNSGDSIQSDFSEKEPCQRVVTISRCGSWMATGGTDGIVRIWTFPGLRLIRALKAHTKELDDLHFSPDSKQVASVAKDGQAIIWEIKSGKQVHKLNWAHPTGIKYIFKRCRFGMIEGKGSRLFTTVNPVAGGKEAQGWIHAWDEGRISKSTSVSEPTSALAVRDDGVFLAIGTMFTGSVSIYIAFSLQRVLHVDGAHSMFVTGVELLPCSSSWGAIEAAALSISVDNRVCIHSLPFRKTLPPWLVIIIIMFTLMFTFILCSCLGL

SEQ ID NO: 12410 - protein, 417 aa, Euschistus heros
MAGAMLFERSVSSRDRDNSRILPTSGRSVDDDNDEEEIKNKEQGILQLGEQYKKEGKAKELAELIKASRPFLSQISKAKAAKLVRSLVDYFLDLEAGIGIEVQLCKECIEWAKDEHRTFLRQSLEARLIALYFDTGMFTEALQLGSSLLKELKKLDDKNLLVEVLLLESKTYHALSNLSKARAALTSARTTANSIYCPPKMQAALDLQSGILHAADEQDFKTAYSYFYEAFEGYDSVESPKALVALKYMLLSKIMLNTPEDVQQLVSGKLALKHAGNDIDAMKSVARASHKRSLADFQQTLKKYKKELEEDPIVRAHLGTLYDNMLEQNLCRIIEPYSRVQVDFISKSIKLPLPQVEKKLSQMILDKKFNGILDQGDGVLIVFEDAIVEKTYEMALEVINSMGKVVDTLYQKAKKLS

SEQ ID NO: 12411 - protein, 599 aa, Euschistus heros
MSTKSPKKTTPASTSSAGPSRSSPRKSETPTPQGARKSPLSPTRYSRLHEKQELANLNDRLACYIDRVRNLETENNRLTREVKSSQENITREVTSVKSLYESELSEARKLLDELSREKTKLQIDTRRLYTENEELKTELEKKTKDCNILQTSLSVSENRLADLTTKYNQLQGERKKLAEENKALETERNKLAAQLSDTRKLLEEETLQRVDLENAVQTLREDFSFKEQLHEQQLLETRTKKQVEISELDGRLSQEYEERLYQSLQEIRDQYECDLENNKEEIKKLYEEKIRSLGSQLTRNSNAAAMAIEEMKNMQAKLNELNRKLLDLEADRNTAQQKARDLEKILEQAKAQYMEEYSQREAEITTLREEMAHQVQEYQDLMDIKVALDLEIAAYRKLLEGEEARLNITPVSSPAQTSSRKVLGRKRKRTFIEESDETDVSNYSVTSSSKCDVAISEVCSEGQFIKLLNKSNKEVSLGGWQLARKAGEASTNYKFHRNIKMEPGATVTIWSSDVPDRSHEPPENLLMKGQRWMVADTMTTVLSNPAGEEMAISEHKKQLLSDRTSSRQREGSFYQKRTFLSSSMRPPSETPGEERCVIW

SEQ ID NO: 12412 - protein, 802 aa, Euschistus heros
MADIKSNEDLSTAILKKKDRPNRLIVEDAVNDDNSVVALSQAKMDELQLFRGDTVQLKGKRRKETVCIVLSDETCPDEKIRMNRVVRNNLRVRLSDIVSIQACPDVKYGKRIHVLPIDDTVEGLTGNLFEVFLKPYFLEAYRPIHKDDTFVVRGGMRAVEFKVVETDPAPYCIVAPDTIIHCEGNHIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEQAEKHAPSIIFIDELDAIAPKRDKTHGEVERRIVSQLLTLMDGLKQNSHIIVMAATNRPNSIDAALRRFGRFDREIDIGIPDTTGRLEVLRIHTKNMKLADDVNLEQIAAETHGHVGADLASLCSEAALQQIREKMDLIDLEEDQIDAEVLNSLAVTMDNFRYAMGKSSPSALRETVVEVPNITWDDIGGLDNVKKELQELVQYPVEHPEKFLKFGMQPSRGVLFYGPPGCGKTLLAKAIANECQANFISVKGPELLTMWFGESEANVRDIFDKARAAAPCVLFFDELDSIAKSRGGSVGDAGGAADRVINQILTEMDGMGAKKNVFIIGATNRPDIIDPAILRPGRLDQLIYIPLPDEKSREAIFRANLRKSPVAKDVDLQYIAKVTFGYSGADLTEVCQRACKLAIRQSIEAEIKREKSRLDGATRMEMDDEDPVPEITREHFEEAMRNARRSVTDNDIRKYEMFAQTLQQSRGFGSNFRFPASSNIPSAPGGGGTETNNFPDDGDDDLYN

SEQ ID NO: 12413 - protein, 277 aa, Euschistus heros
MTDQQMDCALDLMRRLPPQEIEKNLSDLIDLVPSLCEELLSSVDQPLKIAIDKGVGKDYLLCDYNRDGDSYRSPWSNTYDPPLEDGSMPSERLRKLEIEANAAFDQYREMYFEGGVSSVYLWDLDMTGFAGAILIKKAGDGSKKIKGCWDSIHVVEVQEKTTGRNAHYKLTSTVMLWLQTNKTGSGTMNLGGSLTRQMEQDAAVSDSSPHIANIGRMVEDMENKIRNILNDIYFGKTKDIVNGLRSTQALSEQKAQAALRQDLAVALQKRQAKTAEN

SEQ ID NO: 12414 - protein, 1234 aa, Euschistus heros
MQQMDSLQPNNATGLVKSGLEAGAGSGMKEPPPREEPVLDPINGVVQPPVIPPPHRPGRVTNQLQYIQKNVLKAVWKHQYAWPLQQPVDANKLNLPDYHKVIKHPMDLGTIKKRLENNYYWCGAECIQDFNTMFNNCYVYNKPGEDVVVMAQTLEKLYLQKLETMPKEEIELEPPPPKGSKPVKKRPGVIGPGRGGGTTGAGRGRPSNSTPAAAAVVTTPVPPVTPPSHLPATIPGSTATTTVPTTHHNSLPPQVGQPAAVPSNFSTTTVDPLLTPGLAPGVGPKGGKGAVVQTPTAPKPKKGVKRKADLANDSPASFDPTYTPGDSKAAKVGTRRESGRQIKKPQRQSDDGMPFSQSPMAPYSLSNSTQAAHEKPKEKLSETLKACNEILKELFSKKHFNYAWPFYKPVDAEWLGLHDYHDIIKKPMDLGTVKQKMDNREYKTATEFAADVRLIFTNCYKYNPPDHDVVAMGRKLQDVFEVRFAQVPEDSPISTVPEKEEESTSGSSSGSESETDNSDDERARKLSQLQEQLRIMQEEMRKLVEEGTVKKKKKKKEGSGSGGSSSSKKRKSADRTLGKTADGGLIAGAGAPAIMEIKATDGVKAVPPPGRNAVPSPQVKPNKGKAPGRAPGKTNSQGKRPKPNSRSTNSKKKNPVVTSEFNSEDEDNAKPMSYDEKRQLSLDINKLPGDKLGRVVHIIQAREPSLRDSNPDEIEIDFETLKPSTLRELESYVASCLRKKPHKKNVSAKSKDEAMAEKKQELEKRLQDVTGQLGGSAKKTAKKQGQGRLSASSSSSSDSDTSSSSLSSSSSDSSDSEAGKAGRPPRKKNKKNHQIATTAATTVQQNQTVPSLTMTTATGTIVNKNAGAPQPVVPLASTNKPTVPPVSAVTQPEPVKPVVASHSLPPQPARPTATAAPLTTAKRASIPTPATSMGIPPPAPTGLETGPIEIKQELDVPVPLAPVPDHLDFKNLLEVKPELNDIVTGMPSVFDPLPDSPPIIKEEKHPILPHHTDGHLNNSLPPVSNVPGPPIIPSAALPTTPHHLDMNKNSQPPQLPQTPTLQHPFKPKTVEQNLKNASSWSSLAQSPTPALTPTPPTAALKSSMADSFQAFKKQAKENAKKQRALIEQQEMRRHQKEQAERERLRVETEKRREREEEEALEKARKAAVVASGRVEEVKNAAIEEGTSPGSADKAAAERERLRQREQERRRREALAGQIDMNRQSDLMAAFEQTL

SEQ ID NO: 12415 - protein, 430 aa, Euschistus heros
MIPPSSRPQVTVYSDKNEPTGELLTLPAVFNAPIRPDVVNFVHQNIAKNHRQPYAVSAEAGHQTSAESWGTGRAVARIPRVRGGGTHRSGQGAFGNMCRGGRMFGPTRTWRRWHRKVNVNQKRYAMVSAIAATGVPALVMSKGHMVNEVPEIPLVVTDKIQEYTKTKQATIFLHRIKAWSDIQKVYKSKRFRAGKGKMRNRRRIQRRGPLIIYGQDQGLTRAFRNIPGVDLINVSRLNLLKLAPGGHVGRFVIWTQSAFDQLNALYGTWKKKSTLKKDYNLPMPKMVNTDLSRLFKSDEIKSVLKPPRKTIVRRVRKLNPLRNTRAMLKLNPFAAVLKRKAVLADRKLKLERAIERSKKEGIELTPHQKRYVAMLERRKAQIKAAKAAKPKKVKKPKGEKTAAPEPKKATVTKKPAKKATTAAAPKPAKK

SEQ ID NO: 12416 - protein, 1818 aa, Euschistus heros
MADFIDSEAEESEDEEELEVHEKKKLKRLKAMESDEDEEEEDDEERLREELKDLIDDNPIEEESESDDGSGSEEGSGEDRGGEKRKKHDEDFDDRLEDEDYDLLEENLGRKVERRKRFKRLRRIEDEESDGERAEDEGEVRDAIANELFEGSDHEEDRSSSRGPAPERYDDEEEDGEYSDADDFIVDDEGRPIADKRKKRKPIFTDAALQEAQDIFGVDFDYEDFERLGEDEYEEEEDEDEYVDEEGIEDSERRRKPTKKAARKKPTRKSIFEIYEPSELKRGHFTDFDNKVRNTDIPERMQLRDIPVTPVPEGSDELSEEAEWIYKQAFCKPTTSNQEWGNTMERGKPKKEPQTVEKIKKALDFMRNQNFEVPFIAFYRKEYVLPELNINDLWRVFKYDAKWCQLRSRKMTLLSLMEKMRDYQAEQLMKDIDAPIPDHVRVIKDDDIERLKAVQTTEELKDVHSHFLMYYSDDVKVMLEATRIKEREAAKAKARQEKQVDENGDPIETEVEEQEETPPPEIPSVKHSIRSGPYAICRKAGIGGLAKRFGLKPEQFAENLRDNYQRHDVEQEPSLPLELAKEFVSTKFVTPEDVLKAAKFMVATQLSREPLVRRCMRDTFFEKANIDVKPTKKGSKEVDENHPCYVMKYLKGKPVRDLTADQYLKLHIAHQDKLLNVTISDHIGGHTTTSYIEEIKQLYYRDEFMQHVQEWNNIRQECVDVAIKKMLIPELIKELHTRLLEEAKEFVLRSCARKVYNWIKVAPFTVEFGDDDEDDWDTSKGIRVMGVAYVPDLAQASFACMVAPDGECTDFLRLPHLLKRKNTWREDERIHKESDLALIRNFILTKKPHAVVIGGESRDALMVAADLREIISNLVEDEQFPQIPVEIMDNDLAKVYANSLKGESDFRDYPMLLRQAVSLARRLQDPLVEFSQLCTPDDEILCLRFHPLQEQLSKEELLDVVTLEFVNRTNEVGVDINEVVANPICGNLVQFVCGLGPRKGTTLIKILKQTNQRLENRTQLVTTCHMGPKVFINCAGFIKIDTNALGDSTEAYVEVLDGSRVHPETYEWARKMAVDALEYDDEDANPAGALEEILEKPEKLKDLDLDAFAEELERQSFGNKSITLYDIRSELNHRYKDLRVPYQSPGPELMFDMLTKETPETFYIGKLVTATVIGISHRKPEKDQLDQANPVRNDETGLWQCPFCLKNDFPELSEVWNHFDAGGCPGQATGVRIRLDNGITGYIHIKNLSDKHVTDPAQRVTRGQMIHCRVTKIEVERFSIEATSKSSDLLDKSHDWRPQKDPYYDHENEKKDLHTEEEAKKNRQKLTYIKRVIVHPAFHNISYIEAEKIMATMEQGDVIVRPSSKGADHLTVTWKVADGIYQHIDVREEGKENAFSLGQSLWIGNEEFEDLDEIIARHVNPMAAYVRDMFAFKYLKDTEGGLKDKAEEFLKEEKKKNPAKIHYIVSVSKNYPGKFLLSYLPRARCKHEYISVTPNGFRFRGQFFESVNSLFKWFKEHFSDPIPGTPSTPRSAMSARTPYTNTPGPMPINMNAEAIQRVAQNMPNHMLHSLSQVASHTPHYPHTPGAYSLHQYPATPYTPSGQTPFMTPYTTPRYGSGMTPGHQSIISSGSITSPQSSTPGQPVFLHPGSITPSHRTPVANFHRPGSTHPEDWGKKAEEWVAKKRENATRTPRSTPNAGTPRHGTPRDDPNKNRTPRYADNDYTSPRPGANFTSPRYSNWNKVAGTPNSHISAYEDANYDARSLKSPRPPPAQGKYDPYELGQGKSPRYSLTPRSTPRTINSPRSMSLGDSTPLYDESI

SEQ ID NO: 12417 - protein, 761 aa, Euschistus heros
MEESKERKNCRKHERNSDKSDLKSRDERDSYSREGKHRRYHVNDKTINYSSRDRKYDSEHKRYEKLERYWGRGADKDRHGKDMKADYLVGSRYYNETLKNSQIKTSESSTKSKENVNPLESGSKEKQAPKRKNDDIITSRTGGAYIPPGKLKLMQASITDKSSTEYQRIAWEALKKSIHGHINKVNTSNIGVVARLLFKENIIRGRGLLCRSIIQAQSASITFTNVYACLVAIINSKFPSIGELLLKRVIIRFKRAYKRNDKAVCISSATFIAHLINQGVAHEILGLELVTLLVENPTDDSIEVAVAFLKEAGQKLSEVTSKGTNAIFDMLRNILHEGKLEKRVQYMIEVMFQVRKDDFATFPSVPEELDLVDEEDQFTHLIGLDDAIDTQDILNVFKLDSEYQANEERYKELRSEILDTDSEDSGSEASSSEGEEDSDEEDEEKKITIVDNTETNLISLRKTIYLTIQSSLDFEECAHKLLKMEIKPGQEKELCHMFLDCCAEQRTYEKFFGLLSQRFCQVNNTYIAPFEQIFADTYSTVHRLDTNRLRNVAKLFAHLLFTDAISWAVLSNIRLNEEDTTSSSRIFIKILFQELSEYMGLVNLNARLKDPSLQSAMEGLFPRDNPKNTRFAINFFTSIGLGGLTDELREHLKNLPKSIPVTQLIQELSSASSTSSSSSSSSETESSSSSDSSEDGRKKRMKKKKRPIIPKKDSHLNKKKHKKLGNSQESDRSTKETKRKNEYKKSHDRDEKSHGRKSKRK

SEQ ID NO: 12418 - protein, 585 aa, Euschistus heros
MALKALVGQKIMNDAIRQKKKGKEVEWRVLVVDQLAMRMISACCKMHEISAEGLTIVEDINKKREPLPSMEAVYLITPSEKSVHALMNDFASPNRIMYKAAHVYFTEACPNPLFDTLCHARIAKFIKTLKEINIAFIPYEQQVFSLDAPETFQCFYNPSLANSRLANMERIAEQIATLCATLGEYPSVRYRSDFDKNVELAQIVQQKLDAYKADEPTMGEGPEKSRSQLLILDRGFDAVSPLLHELTLQAMAYDLLPIENDVYKYEATAGAPEKEVLLDENDELWVELRHQHIAVVSQNVTKNLKKFTESKRMPQGDKQSMRDLSQMIKKMPQYQKELSKYSTHLHLAEDCMNAYQGHVDKLCKVEQDLAMGTDAEGERIKDHMRNIVPILLDQSVSNYDKMRIILLYTLSKNGISEENLNKLVQHAQIQPHEKQAIVNLGNLGLNVVVDGTRIKKPYVPPRKERITEQTYQMSRWTPVIKDLMEDCIDDKLDLKHFPFLAGRAASSGYHAPASVRYGHWHKDKGQQTVKNVPRIIVFIIGGMSFSEIRCAYEVTNAVKNWEVIIGSSHILTPEDFLSNLANLSN

SEQ ID NO: 12419 - protein, 705 aa, Euschistus heros
DPYSYEDFVERLAWRTVDGFKEDGIHGFDPNLMHETFLQAIKDLQVLQDRQYKKCEKLELICKEEEANHFQDIAHLHDKNKEAVALFQDLDERINFVATKVIHLGDQLESVNVPRSRAVEAQKLMTYFSEFLSPGPVVASVFSSKDEVFEAADIIQKLHMISQELPSDKFKDARSKISLKYDEIERSLIEEFVKAHRVHETMRMKDIANILMHFKSYSQCIDAFIEESQMGTFVGKDIFKEILPLTKKNFSIMREVFSNPEQVMAKFVLNIYHLKLQKHIVSNLSDKSDTNKYLRNLMELYTRTTELSAELSGFKMGSDDSYLQKLTQNIFQKYLESYISVEVKGLKEKCSTLLQKYYDSKDHHKRQIQSGGFQDFRRDLQAVIGTRANINIAQIEDYGGETFLSEELVISLIQESKQAFYRCKLLSKPADLASNTVQLLEVLLNCIIIDHVDYAVELALQAVPIPESKTQAQPIYFFDVVRQANTIVHLIEKHFNDSALPLVMSTSKHGECVMKKKFLLNHLEQKLDNGIDRALNAIVGWVKVFLQSEQKKTDFKPDTELNTLSSAACIAVVQYFNDNVKHIRACLDGRNIECVMTELGCRFHRVIYDHLQQFQYNSTGALCVICDMNEYRKCVKELNSYLVNTLFDTLHALCNVLLVKPENLDQVCTGDQLSLLDRSVVLNFIQLRNDYKTQKLSNFLKGMSA

SEQ ID NO: 12420 - protein, 276 aa, Euschistus heros; identical to SEQ ID NO: 12307

SEQ ID NO: 12421 - protein, 134 aa, Euschistus heros; identical to SEQ ID NO: 12308

SEQ ID NO: 12422 - protein, 475 aa, Euschistus heros
YNQLNRNLVLAELPYFLSDNPILSRSSALLKSFRIFIQMASSVSKVPLLQTVAKRSFAAVAAPQSGRCKNKVEVTTLPNKAVVTSLGCEPSSLVKVAVAFRAGSRSETSDNFGASHILRSSAGLSTCSASSFYICRSLQQNGASLTATSDRETIVYLLESSATNIKEGLDVMKKAITGQEFRPWELSDNIPRIKLELASLPPQAKVIDLIHTAAFRSGLGNSIFVREFNIKKINCETLQHFYASNFTGDKAAVAGCGIPHSFLTSFADSLGLCSGIPSQIQASKYRGGEIRIEENIPFHHTIIAAEAPGLDKSDALAYAVLRYALGTGPSVHRGQGSGPLSKIPAKAMALSMAHSDAGLFGVYVSSLGTDAKEAVEGAVKALKCGVTEQDVARGKAQLKSELLYSGETCRGIVDDLVGQALLVKGAPPMTIVELAEKVSSVTTQQVQQALQKIQSGKKSFASIGNISKVPYLDEL

SEQ ID NO: 12423 - protein, 112 aa, Euschistus heros
MRRAHGNYYQPVPTFDGPSGSLEEENDQMTNKLKDKITALKHLSIDIGAEVKYQDKMLHGMSEDFDRTGGFLGNTMNRVLRLTKGSHNYYILYLFIFSIVVFFVLYIVLKFR

SEQ ID NO: 12424 - protein, 496 aa, Euschistus heros
MAISSNQAVKEHVLAVSRDFVSQPRLTYKTVSGVNGPLVILDEVKFPKYNEIVQLRLADGTLRSGQVLEVSGSKAVVQVFEGTSGIDAKNTICEFTGDILRTPVSEDMLGRVFNGSGKPIDKGPPILAEDYLDIQGQPINPWSRIYPEEMIQTGISAIDVMNSIARGQKIPIFSAAGLPHNEIAAQICRQAGLVKLPGKSVLDDQEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHSDVSNQLYACYAIGKDVQAMKAVVGEEALTPDDLLYLEFLTKFEKNFISQGTYENRTVFESLDIGWQLLRIFPKEMLKRIPASTLAEFYPRDSRHTTTK

SEQ ID NO: 12425 - protein, 742 aa, Euschistus heros
MMQQAQSRPMSHGNYQGGPDLPMGSVKDQTLMWQQSSYLADSGIHSGATTTAPSLSGKEEEMYGDQDMFDLDQGFAQGFTQEQVDEMNQQLSQTRSQRVRAAMFPETLEEGIEIPSTQFDQAQSTAVQRLAEPSQMLKHAVVNLINYQDDADLATRAIPELIKLLNDEDQVVVSQAAMMVHQLSKKEASRHAIMNSPQMVEALVRALSNSNDLETTKGAVGTLHNLSHHRQGLLAIFKSGGIPALVKLLSSPVESVLFYAITTLHNLLLHQEGSKTAVRVAGGLQKMVALLQRNNVKFLAIVTDCLQILAYGNQESKLIILASQGPIELVRIMRSYDYEKLLWTTSRVLKVLSVCSSNKPAIVEAGGLPALAMHLGHPSQRLVQNCLWTLRNLSDAGTKVGGLEGLLQSLVQLLDSTDINIVTCAAGILSNLTCNNQRNKVTVCQVGGVDALVRTIISAGDREEITEPAVCALRHLTSRHMESELAQNAVRLNYGLQVIVKLLHPPSRWPLVKAVIGLIRNLALCQANHTPLRDHGAIHHLIRLLMQAFQDTHRRSSVTSGGTQSGGIYADGVRMEEIVEGTVGALHILARESHNRAIIRGQMVIPIFVQLLFDEIENIQRVAAGVLCELAQDKEGAELIEQEGATAPLTELLHSRNEGVATYAAAVLFRMSEDKPQDYKKRLSMELTNSLFREDQNLWNGDLGMAPDLQDMLGEQNYDTMYSHGPPSVHSSHGGRGYQPGL

SEQ ID NO: 12426 - protein, 273 aa, Euschistus heros
MARNAEKAMTTLARWRAAQLGEGDQAKQRRPYLASECTDLQQAEKWRMQIIREIARKVSQIQNAGLGEFRIRDLNDEINKLLREKGHWEAQIRELGGPDHSRSGPKMLDAEGKEVPGNRGYKYFGAARQLPGVRELFEQAPPPPPHKTRGELMRDIDASYYGYMDDEDGIIIPLEEIEESKAIKKAVSEWTVKKEKSMEIEEEEKEEVEEDNIYKIGNKEGEEDDEEVEDDGFELSAKLLEGYRAHIPVPSQREVEAAILERKKQELLERYAL

SEQ ID NO: 12427 - protein, 214 aa, Euschistus heros
MEEADVPSFKCVLVGDGGTGKTTFVKRHLTGEFEKKYVATLGVEVHPLVFHTNRGPIRFNVWDTAGQEKFGGLRDGYYIQGQCAIIMFDVTSRVTYKSVPNWHRDLVRVCENIPIVLCGNKVDIKDRKVKAKSIVFHRKKNLQYYDISAKSNYNFEKPFLWLARKLIGDPNLEFVAMPALLPPEVNMDPEWRDQIEKDLQEAQDTALPEDDEDL

SEQ ID NO: 12428 - protein, 159 aa, Euschistus heros
MDIQTIATIFIKVLKLVINFIILMLYRYGGKQGFLGVGGTWNLYEVKSADAEIIASGVFVGFFIYTSVILISYCFGTTKHKYSAVDIIMNVCGTILFTAVGGIALHYWVGFQDENHYVGISQEKQIGLALGSLCVVCAAIYLLDTVLSCIHIAHKHAIA

SEQ ID NO: 12429 - protein, 778 aa, Euschistus heros
MPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEEGEDGADDPRKLKPGEIDPNPETKPARPDPKDMDEDELEMLSEARARLANTQGKKAKRKAREKQLEEARRLAALQKRRELRAAGIEYAARHKRKRGIDYNAEVPFEKKPASGFYDTSNEAIDPHAPNFNRLRQQNLDGELRSEKEERERRKDKQKIKQRKENDMPLAMLQNQEPAKKRSKLVLPQPQISDQELQQVVKLGRASYAAREAVTEGSESASDTLLNDYALATPNAGSTPRTPAPTTDRILQEAQNMMALSHVDTPLKGGLNTPLYNSEFSVNPPAEQITTPNTVLTTPFSNRTHEGRTPGFQTPQDVRNSLTTPVRDKLNINPEEGGDTPYAPVNNQKLVKEELAARLRSLPQPKNDYEIVVPEDEVSSETAAEGSGMPSIEDQADIDARNLSLLAQQREKELKSRSQVIQRGLPRPGDINIVLRPANTDPPLTDLQKAEEMIKEEMITMLHYDAMHSGEPPSSRKIGTLSQAQHLAYLEQHPYQTYSEDQMEKAKEMLKAEMEVVKQGMNHGDLSLETFTQVWEECLAQVLYLPNQNRYTRANLASKKDRLESVEKRLEQNRTHMTREAKRAAKMERKIKIITGGYQTRAQALIKQLQDLADETDKAHMELSTFKLLQQQEENAIPKRIESISEDVNRQLEREKSLQKRFSQLQLVSQS

SEQ ID NO: 12430 - protein, 157 aa, Euschistus heros; identical to SEQ ID NO: 12317

SEQ ID NO: 12431 - protein, 371 aa, Euschistus heros
MKESLKKFREEAQKLEQSEALQKARAKFQTVESEASKGSEVFKEKLDHIKDRVSDVLEEAAKSEIGKKAGQLGAEIGKTARGAAETISERGQQIGKSGAFQTISQTAAAVKQELDQTGIHAHVYQPPQKLRRRLETMPDNKTLKPDTETLGIDLHKDSKFFQSWQQFKDNNAYINKVLDWKMKYDESDNPVIRASRVFTDKVSSVMGGLFQKTELSETLTEICRIDPNFDRAHFLKDCEKDIIPNILEAMVRGDLDILRDWCHEGPYNILAAPIKQAKDAHFKFCSKILDIDNVDLVMGKVMDQGPVLVISFQSQQLLCIKDKNGNIVEGDPNKVLRVNYVWVLCRDPSELDPKAAWRLLDMSAQSTEQLL

SEQ ID NO: 12432 - protein, 300 aa, Euschistus heros
MKRPTFRELQLEELENYEEETDSDTEALQEAFVKGELKPGLNIPVKERTKTNNVPLLKEVLNDIKLDLPWIERLDVTNDQAPLAPELALQIRDEEKGHNPLVYDELKRESVFYRQAQNAAMKILPKLKQLGLRTERPGDYFAEMAKSDQHMQKVKGEAIKKKLMMERIEKLREIRAQKKVQKALHAQAKVAKVQNKKEMLDEVKKYRKGETKSLAFLEPGYKAKPKANKSQIKRQHKNAKFGHGGKKRGAKRNTRDSTSGIERRQSKPSFANSAGKGKKAMKQKRPGKNARLKQKSRRKN

SEQ ID NO: 12433 - protein, 850 aa, Euschistus heros
MDEVKKLEHLSLVSKICTELENHLGLNDKDLAEFIIDLASKNNTFESFKKALLDNDAEFSDSFISNLLRIIQHMRPKNEPVLTKDLTKQDKLSMKFPGLAIPNDVQQPKNHNNKKFNLSVIKEDPEDNEVEDAMAALEALAPSNEKKFSSKVERASHSPEKIVKQEVEKPRKRSRSRSRNRDRKRNRSRSRSRGRGRSKEKTYGKSRQRSVSRGRRRRSRDRSSSRNRNQVKNWERDRRGKNDRRSRSNGRKRNERSRSRSVGKRRNDRSRSRSYDRKKNDKKRENDDEKNKSDEPLEPEVGKIYNGKVTNIVSFGCFVQIEGLKRRWEGLVHISQLRREGRVTSASDVVSRGMKVMIKVLSVAGQKVSLSMKDVDQETGKDLNPTVRHAINKDREEEASMRNPDRPTTLLDLGSFDDHDDFQSRKRVNRISSPEKWEIKQMLSASCIDKSELPDFDEETGLLPKEAAEEEDIEIEIVEEEPPFLQGHGRNLHDLSPVRIVKNPDGSLAQAAMMQSALAKERREQKMLNREQEMDQMPTGLNKNWIDPLPESDGRALAANMRGIGLTNQDLPEWKKHVIGGKKSSFGMKTNMTLLEQRQSLPIYKLKEQLIKAVTDNQILIVIGETGSGKTTQMTQYLAEAGFTSRGKIGCTQPRRVAAMSVAKRVAEEFGCRLGQEVGYTIRFEDCTSPETVIKYMTDGMLLRECLVDLDLKSYSVIMLDEAHERTIHTDVLFGLLKQAVQKRSELKLIVTSATLDAVKFSQYFFEAPIFTIPGRTFPVEVLYTKEPETDYLDASLITVMQIHLREPPGDILLFLTGQEEIDTACEILYERMKSLGPDVPELIILPVYS

SEQ ID NO: 12434 - protein, 665 aa, Euschistus heros
MNTGPGGPNYPMASLYVGDLHSDVTEAMLFEKFSSAGPVLSIRVCRDMITRRSLGYAYVNFQQPADAERALDTMNFDNLKGRPIRIMWSQRDPSLRKSGVGNVFIKNLDKSIDNKAMYDTFSAFGNILSCKVAQDENGVSKGYGFVHFETEEAATKSIDKVNGMLLNGKKVFVGKFIPRKEREKELGEKAKLFTNVYVKNFGEDFTDDMLKEMFEKYGPITSHTVVVNKDGKSRGFGFVAFEDPEAAERAVEDLNGKELIEGKPLYVGRAQKKAERQQELKRKFEQLKMERMNRYQGVNLYVKNLDDTIDDERLRKEFSPFGTITSAKVMLEEGRSKGFGFVCFSSPEEATKAVTEMNGRIVGTKPLYVALAQRKEDRKAHLASQYMQRMANMRMQQMGQIFPTGGTGGYFVPTLPQPQRFFGPAQMAQMRPQPRWPAQPQVRPSTQATASGFPNMQGPFRSGPRGPGAAGGGGGPGSAAAAAAAMRSSISAAAAAVAAAGRPTANAAAAAAAAAANPAVARQLAQGASQGAPVSVSAQGRPANYKYTANMRNPPQMGGGAGAGAGGPPQQALHIQGQEPLTASMLSSANPQEQKQMLGERLFPLIRSMYPDLAGKITGMLLEIDNSELLHMLEHHESLKAKVEEAVAVLQAHQAKQAAASVKKE

SEQ ID NO: 12435 - protein, 912 aa, Euschistus heros
MTDSKYFTTTKKGEIFELRSELNSDKKEKKREAVKKVIASMTVGKDVSALFPDVVNCMQTDNLELKKLVYLYLMNYAKSQPDMAIMAVNTFVKDCEDANPLIRALAVRTMGCIRVDKITEYLCEPLRKCLKDEDPYVRKTAAVCVAKLYDINPQLVEDQGFLDQLKELLSDSNPMVVANAVAALSEMNEASVNGAPLIEMSAATINKLLTALNECTEWGQVFILDSLANYSPKDEREAQSICERITPRLAHANAAVVLSAVKVLMKFLEMLPSDSEFVSTLTKKLAPPLVTLLSSEPEVQYVALRNINLIVQKRPDILKQEMKVFFVKYNDPIYVKLEKLDIMIRLASQANIAQVLSELKEYATEVDVDFVRKAVRAIGRCAIKVEQSAERCVSTLLDLIHTKVNYVVQEAIVVIKDIFRKYPNKYESIISTLCENLDTLDEPEARASMIWIVGEYAERIDNADELLESFLEGFHDENTQVQLQLLTAIVKLFLKRPTHTQELVQQVLSLATQDSDNPDLRDRGFIYWRLLSTDPGAAKEVVLAEKPLISEETDLLEPTLLDELICHISSLASVYHKPPTAFVEGRAGLRKSLPARSGSAEVVQETPGAQVIPSQDSLIGDLLSMDIGGVSAPPPPPTTSAPVDLLGLDSLLGGVPEPTVSQSTTGLLGDIFGLGSAGPTTYSPPKTMWLSSERGKGCEISGTFSRRNGQIQMDLTIVNKAMQPMTGFAIQLNKNSFGVTPARALQVLSPLPPGTSHDCSLPLVTTGAVQRMDPLTNLQVAIKNNIDVFYFACIIPMHVFFTEDGQMDKRVFLATWKDIPAQNEVQYTLTNVQSNADMVVQKMQENNIFTIAKRNVEGQDMLYQSVKLTNGIWVLIELKIQPGNPNITLSLKSRALDIAAGIFQVYDAILHS

SEQ ID NO: 12436 - protein, 165 aa, Euschistus heros
MPPKFDPNEVKTVFLRCVGGEVGATSSLAPKIGPLGLSPKKVGDDIAKATADWKGLKITVCLTIQNRQAAISVVPSAASLIIKALKEPPRDRKKVKGVKHNGNLTFDEILSIARSMRPRSMSRKLEGTVKEILGTCQSVGCTVDGKTPSEVISQINDGEIDVADE

SEQ ID NO: 12437 - protein, 369 aa, Euschistus heros
MCGDEPKLGEMKALILVGGYGTRLRPLTLSRPKPLVEFANKPMLIHQIEALVEAGVTEVVLAVSYRAEQMEKELSEEAKKLGVKLIFSHETEPLGTAGPLALAKDILTSSNEPFFVLNSDIICEFPFKELVSFHKNHGKEGTIVVTKVEEPSKYGVVVYDEKGCIASFIEKPQEFVSNKINAGMYILNPSVLGRIKLEPTSIEKEVFPFMAEEGELYAMELKGFWMDVGQPQDFLTGMCLYLTSLRQKAPEKLYSGPGCIGNVLIHPTARIGSGCSIGPNVTLGPGVVVEDGVCIKKCTVLENATIKSHSWLSGCIVGWKSVVGQWVRMENTTVLGENVNIKDELYVNGGQVLPHKSIAKSVQDPQIIM

SEQ ID NO: 12438 - protein, 287 aa, Euschistus heros
MTLDGEETISDQEKVRIVSNFILHSPPGEFNEVFNDARILLNNDTLLKEGALGVFGQYCKDQLTPVKIKNSEYPVLITEHNDLGSNRFYDARSKQSFKYDPLRRETSNYDSWEAEPGTEKWRSALEVELDAYIAKHFESGSGSVFSKREDGKVSLVACIEAHLFQPKNCWNGCWRSQWFVTIDSDNADVKGVLKIQVHYYEDGNVQLVSLKDINQSLQVADEQQLSKALIKIFEDSETEYQQAISENYHTMSDTTFKALRRQLPVTRSKIDWNKMVSYSIAKELKPQ

SEQ ID NO: 12439 - protein, 1267 aa, Euschistus heros
MEVGLLLVILVGLVASKEVNQVSEKLVRPFSRYPTRLRGFANGLQPNADDDRVAPSTDQPNIPYVITEDRLKKIRSNLLYWFFDQDLEGGYGDLQKDITPSITQVHKNLNFQLPFFGFRFNYTRVSLNGYLEFSDPPEQYSYPLTFPTVEWPRKNDPSFIGIFYSKCRIGQLGVNDVDQREPGVYFRMERDLMTRKDKFGVEMRERLKWDIRESVVGSDSFEPKHAVIVTWKNVSFAGGIENSVKTTNSFQLVLATDEVFAYAIFNYVQIKWTTHTEARGDTVGGEGGIPAFIGFNAGNGTRSYEYRPYSQTSTIRDLVGRGWANGFPGRHIFRIDENILPGTCNKDIAAASLPLSFAPESGNMLGGTIVNITGPCFEPTMKIVCRFDMKSVFGTVVDRNRAICVQPFVMAEGYILFDIAIDDGKYIWKGQYFIETPATAAEKISFADNSVHQKYPPEVRITWNQNNLTTNLAAPVQISIWGYREKSTRTELHYIDSLDVGVPNNGQYSIIPGTYKNRDNSFFSDMTFGFIQINLTTAMDYNGLKVTPVIWSKPIPLGWYFAPQWERQLGKNWPEGKCNNWIMNDRYLKNFAAELSICPCKLEQALADKGKFMPDFDCDMDANPHCFYHEGARHCVKTGAPRQEGAEQQCCYDKNNYLMLSYDQQWGSSPKRCSNLGILPWNEANKVPTLSQWYHDISPFYHCCLWQFEQSVGCETFRFERRPSQDCVGYQSPYIATVFGDPHFITFDGLEYTFNGKGEFVLLHTDSERFKLDVQARFEQVGKNIYGDVAATQLTSIAARDNTSSIIEVRLRPKEAQWRYRLDVFANKKRIYFDRPSLRVQHFTGVTVYQPSHVLNQSEIIMMFQSGVGVEVVENKGYMAARVYLPWEYINRTRGLFGNWSFDPSNDFTLPDGTVVSAENLNDFERIHKQFAIYWRLEDNVEPNKGEPLFVREYGRTSSYYLNRTFVPVWKSTPQEIIPPNRTKDIQQALALCGESYQCRYDYAVTLNREMAFYTLNYYSEYTQLRQTNKERVLSCGVLETPRFGRKSNFFFVPDSKVIFECDQGYILVGDPRRTCSSSGRWSFEYGYTECLRYIEYDAQQIAKTVMVIGLILVPLIMIVICAAVYIIKKAKGDSSQASWKFSKVYSAPSSSYIPAKTHPSQDPHQASAPFMKNDDSSPDTTRSIGYPGHSNMSLDKSQGLKPILSLPYDKTYYTHEPLRNRPPIDFEDYEEEGVQLSGDFNDRNDAPTLKVKDDFRRHNSVETDIF

SEQ ID NO: 12440 - protein, 113 aa, Euschistus heros
MRYVAAYLLSSLGGKESPSAADIDKILSSVGIESDSERVNKVISELKGKNVEEVIAAGKEKLASVPSGGGGAPAAAAAAPAAASPAKAAEEKKEAKKEESDQSDDDMGFGLFD

SEQ ID NO: 12441 - protein, 915 aa, Euschistus heros
MVVMMSDHIGGITLKWDPKNLEIRTLSVEKTLEPLVLQVTTLVNTKGPSKKKKGRSKRAHVLVAAVEKATENFIEKGEMIAYENPDIKQEMLSAVEEVRKTGEAMSAAAREFADDPCSSIKRGNMVRAARNLLSAVTRLLILADMVDVHLLLKSLRVVEDDLVKVKNASSQPELLENIKAFGRNASELMSQAAKRQLELKDSQLRDDLAAARAVLKKHSTMLLTASKVYVRHPELAAAKANRDYVFKQVCEAVNTISDVAQGKGPSITTNPYEGPGELAAALDDFDERMVMEPLAYSEVATRPSLEERLESIISGAALMADSSCTRDERRERIVAECNAVRQALQDLLSEYMANMSVKEQSEGLERAIDHMCRKTRDLRRQLRKAVVDHVSDSFLETSVPLLVLIEAARAGNEKDVEEYALVFQEHANKLVEVANLACSMSGNEDGVKMVRYAAAQIDALCPQVINAARILGARPKSKVAQENMDVFRDSWESQVRVLTEAVDDITTIDDFLAVSENHILEDVNKCVMALQEGDGDSLDRTAGAIRGRSARVANVVTAEMDNYEPGIYTERVLEAIKVLREQVMPNFAQRVEVAVDALSSNPPKDVDENEFIDASRLVYDGVREIRRAVLMNRSSEELDTDTEFEPCEDNMTIDTKNRPSAHTADHGVDEYPEISGITTAREAMRKMTEEDKQKIAQQVEYFRTEKLKFDREVAKWDDTGNDIIVLAKHMCMIMMEMTDFTRGRGPLKTTMDVINAAKKISEAGTKLDKLTRQIADQCPESSTKKDLLAYLQRIALYCHQLNITSKVKADVQNISGELIVSGLDSATSLIQAAKNLMNAVVLTVKSSYVASTKYPRQGTVSSPIVVWKMKAPEKKPLVRPEKPEEVKAKVRKGSQKKIQNPIKALSEFQSPAESV

SEQ ID NO: 12442 - protein, 413 aa, Euschistus heros
MNDNNLQSTPKTNASSSFFQTNTPKPASNVSFGSTMSTNQTQGTGFLNFTPPVGTSKQSTMFMPPASLTNTSTPKTTATGNATLFNITTTAATPASVPGGAVTTSFTLGSSSSLTTSQQFKPPSTSQPIQLKTSTPGASMPLGTGLSSTGGNAPPTGLNFGSAPKSTNSGSTIFSSTKSSLPASNAVTTSSLTLTPSSTTSLTNSLSNKPVTSTGATTSQQQSLTFQQLEELILNKWTAELYEQEKVFLNQATQINIWDKVINENAEKLTQLHSTMEKVRKQQTKINDDLEIISTHQKDLEACLVPMEKEDLLSVLKADPNRKNLYINAKKIDSQIKTMSEDLKETIEHINETSRSHDTEDPVIQVGRILNAHMESLRWIDEHTARMQDYFDSLLKMHDDLRRECEISKHDVY

SEQ ID NO: 12443 - protein, 193 aa, Euschistus heros
MFIWDWFTGVLGYLGLWKKSGKLLFLGLDNAGKTTLLHRLKDDRLAQHVPTLHPTSEELSIGNIRFTTFDLGGHTQARRVWKDYFPAVDAIVFLVDACDTSRLPESKAELDALLTDESLINCPVLILGNKIDLPGAASEDDLRNFFNLYGQTTGKSKVPRSELSGRPLELFMCSVLKRQGYGEGFRWLAQYID

SEQ ID NO: 12444 - protein, 594 aa, Euschistus heros
MAENNIYDEMILTVTSEKFYIEPIEDVDNNLVLDRLTGNITSNVSRNSGDAPIIGEKKPIYGIIGIIRLLAGQYLVVVTGRTKIGNIWRKEIFQMGSAEVICISRSITHLNDMQKKIEKEYVSMLESILSTPNFYFSYSYDLSHTVQRLHNISPDFLKMPMYQRAEQKFVWNEYLLSELSKNCADSRFCLPVIHGYLSITSCILNGKTFSLILVSRRSKERAGTRLFTRGIDSDGNVANFVETEQIVETKFERASFVQTRGSMPFFWQQYPNLKLKPRPVIQEENHTAAFTKHFNTQIMDYGRQVIVNLVDHSGSEGKLEELYRKLVNEANIADLKYEAFDFHRECSKLRYDRLKILIDRLAYDLEQMSVTMIVGNGTVVSQQEGVFRTNCIDCLDRTNVVQSMLARVNLSYVLQKLSILKKGETVEDQVQLEKVFKLLWSDHADLISTQYSGTGALKTDYTRTGKRTTAGIVQDGINSLVRYYINNFQHGFRKDALDLWLGHYRVSSEEGIVIKSPIGVKREFKYKAFPLILLVAVAIFFANLVTANEYTTGTLLSLIFWFSMVSATVMVIFYNGSEYVNCPRLCPLLRSPSV

SEQ ID NO: 12445 - protein, 516 aa, Euschistus heros
MSPTVPTTTNVVDKRPTLVKPHSAERRSELVCRVKYCNTLPDIPFDPKFIQYPFESTRFIQYNPTSLERNYKYEVLTEHDLGVTIDLINKDMYAADHNAVLDPADEKLLEEDILAPHDSKRSRHHSRAVSWLRRTEYISTEQTRFQPQVMDKVEAKVGFSIKKSLKEETLYMDRESQIKAIEKTYDDAKLPIEKHHSKPNVVPVEILPVFPDFQLWKYPCAQVMFDSDPAPIGKTVPAQLEQMSQAMIRGVMDESGEQFVAYFLPTDSTLEKRRRDFTNGIDYEDEEEYDYKIAREYNWNVKTKASKGYEENYFFVIRHDGVYYNELETRVRLSKRRQKAGTAPNNTRLVVRHRPMDANEFNIHRLREKQLQHPVEEEDEEESAGEEDKKEEEKKTNSKDSDESDKEEGSSEKEGSDKDEGSGKEDGSGKEDGSGKENNSDKDEASDKEAESEASDKEDSDKEASDKDDKEESGKERGSGSEKSGDESEAESSASGGGSSRSSASGSSKSGSEEED

SEQ ID NO: 12446 - protein, 400 aa, Euschistus heros
MDNEGVTPAYMKLSQIKFALSLPEYQGDVALKEELLNGIKAGNMAPYYREVCNDLGWVMDESLCAHMVKNNELRLAELEKEHENSVIEDEEQVSGLWQAKLDYLCSIGDKENATTLANSKLQDKTVPKTHRIDAVFALFRISYFHGCDIKGMSAAIEKATELIEGQGDWSSRNKLKAYEGVWSFAVRDYLRAAKLFVDVVPTFESYELADFGTIIKYTVLSCMIALPRCELKKKLMHHGVMAQALHSQYRNLKEYFQSLYDGHYADFLVALAQVESDMKRDPLLHPHYRHYVQEMRLRAYKQILQAYRSLSLDYMAEAFGVSCEFIEREVAKFAASGRLQCKIDSVARSVITSVHLSDEALRVKDSSDLDLDRSLLYKTTVKRGDILLNRLKKLARVMDF

SEQ ID NO: 12447 - protein, 1327 aa, Euschistus heros
MSSITLSHFQKRPRYADFGRKRGAKTKMRGIFGVPGLGLQRPLMDSNTKPEDEPGLENKLVLVSSRDKYVLSQDVCVMCGALGQDQEACLIACAQCGQSYHPYCVSVKVTKVMLQRGWRCLDCTVCEGCGQKNDEGRLILCDDCDISYHIYCMDPPLGSVPSGVWKCKWCAHCQTCGSNSPGPNAVWQANFTQCGPCFSRTTCPACLELYTDGDLIIKCIHCDRWLHCLCDTISNENEAEACCAQGYTCLLCRPSHVALVLPATTPSRAPSPEINTESKATDYYVDGVCLSETGLQLIKTLSMDNGNQPVRRKRPGFRRQDPSLELVDDMDNEGKETLYKDGMFWGSKENGPIPSPPEGFTLYTRESGIVVLKRLKKRNLQRLGIGGFTTVKMRSTRLKEDDEHLYPEEKPRRKPRVPKKKSKIAESYPRHLQEAFFGKELLDTTMETSQKLESTGDESDDGKLREEEGSDGETLKDILHLPENLLHNDLVNTIMNESADSIKSENLMSESGHEGSGSQKDELCDILGPHFSIESMVRETGLPNMDSKDVEEIFKKVLTDESRNQGHHNQASPQQQHPAAKSTPAALASSPLQYPSASPYNSEYSNSPQFSPESSWDDLGSYNRTTSLKMEADESLGRDATISPVLYANINHPEWKKEFPSWNERFKQILKKWRALPSEEKAPYLQRARDNRANFRSRKQEHDKTLNTKSCREAEQERQWKELQALRQQQQHMLSQTRVQQVNRVRQVGNTGLVQFSTTEQPPSPHLTQQLQVSTSSQEASLGGLGSPRAQFASGTGGTVKVATPGGGTTIYRQVRPPQSPFPSPSPRQPSTPQQQQQEEVRQLRDLLQRHQVKQEGTETVLSGGVLQGVQMRPQPPRSSLHPQAVHGMEPRVRLVVQQQPSRFPGTTQVRLAAPRAQLQDQFLIQRQFAAAAAAQHAHNASAIIRNSSNLVEQTRLQSIPVDQRIQTGGREGEEIPESVTAELEKLEEEGGTIGGEADEVSAIFSGLVEDDDELLAEMGPDFNILEYADPELDTVSGGEKTNILDDLEDEVEKKKQMSSRKENTARRSSSDSINKELTEPRPESKPSEEVNRVSVTSTPPHLPQQISLSGNSGITQPKIVGSGYQTQFATPSTPLPRMQVLQGANQVSRGNASFVGNPPPPPPPYPGPPPPYPGQQAAIRGRGVRSHIIPGPAAQAQQRRTLLLQEQPLLLEELLEEEKREQEKASVAPSPASSLMSDADFEMLRADVLGSRTTSPPQSQSLGTLNLVGPPPPPPPENIVTEADRQAQVQYETWLRTTGSAVSQQIRYFETEVQKLRKIRKSLNSK

SEQ ID NO: 12448 - protein, 1435 aa, Euschistus heros
MSEDSENHKARPKRNLSGKQKKLDLLEKLKSGKKNKYDIGELENVYEEVDEKEYTRKVLERQDDDWIVDDGGCGYVEDGREIFDDDLDEESIKKSQNIVTGRKRGRDIAPEKKGNIRNMLAKMPSKKKKKETVVKLEEDDILGDIIGEIDSTSVVPLKNSNKQPEISEKDYLKSLTNFKSTKVKPSPVKRVKTSSEVKTLPLVKETEKHKMADLPVETSPIKIKEEPIDVDEIQDYSCDMFGDDFDHEDIEISDSKAEEVCSRDIKVEPVSPPREASPVKMEVVKDEISEDWDKQIEFDSPVTYVNVDKSKLPLLKNETGQEVLRFYYWDAAEEVYSQPGTVFFFGKVLIESANTYVSCCVSVKNIERRIFLLPREEKMNLKTNETYGDSVTMTDVYQEFSSAVADKYKIKQFKSRKISKKYSFGDSSVPSESEYLEIRYPSTFPALPSDLKGETFSHVFGTKTSFLEILLLERGIKGPSWIEITNAEPVLAPFTWCKVEASCMKANDVNVLKNGLPPIPPLVLVTLHPQAVHNPKTKQTEIVAVGCLVSNSYPVDKPPPDRLFNQHFCVFSKPSDLTWPYDIKESLSNFKKTSLERMESERALLNLLLTKLYRIDPDIIVGHDLSGYGIELLVKRLAFHKVPNWSRLGRLKRSVIPTTKARNQIEKIALTGRLMCDIKVTGKELLRARSFDLDSLCQLVLHFQENKRQDFTDEEFKSCFFSGENLVKALWSIMTDASYILRIFTELNALPLALQITNIAGNVMSRTLMGGRSERNEFLLLHAFHSKGYIVPDKEYKKTAKDDDVDGTAEVTTNSRKKPSYAGGLVLDPKVGFYDDLILLMDFNSLYPSIIQEYNICFTTIPPSSIDMDEDFNENYQKYFPEESMEPGILPTEIRKLVESRRHVKKLLKSAASPEQKMQYDIRQMALKLTANSMYGCLGFSNSRFCAKGLAALVTAKGREILLTTKRMVESFGYEVIYGDTDSIMINTRTKDFEQVHQVGKKLKFEVNKCYKQVELDIDGVFKYMLLLKKKKYAAVTINKLPNGEFVEKQEMKGLDIVRRDWSQLAAAAGRHILNEILSNKSSDDRIDGIHNYLEKIRSDLETNKVPVTLLTVTKQLTKPPEEYTDAKNLPHVQVALRLNKNSAKRLKQGDTVSYVICKDGTNNSAAQRAYHVEELKNQDNLSIDVLYYLEQQIHPVISRLCDPIDGIDAASVARCLGLDPTKYARVTTITEESDEITKYTLGRANEERFKDCERFVFTCKNPNCKTDNTVEGLRHKEDNGVEGLLMLEKCKNPECKVSPVEYLPSIQNQLHFRIRYHIQKYYEGWLICEDPVCQNRKRIINPIFSKGFPECNKCYRSTMRREVSNLSLYTQLTYFQFLFDLSRDAITTIKVEPEIVNAYKRLYDQVGEVLKQNKYSVIDLGSLFSQLFPFKRDK

SEQ ID NO: 12449 - protein, 486 aa, Euschistus heros
RYYLWRPRKHSGRLLFFKSEMAAGTQVKNVEVRDIARIERIGAHSHIRGLGLDDSLEARAVSQGMVGQQMARRAAGVVLGMIKEGKIAGRAVLLAGPPGTGKTAIAMGISKSLGKDTPFTAMAGSEIYSLEMSKTEALTQAIRKSIGIRIKEETEIIEGEVVEIQVERPATGVGAKVGKLTLKTTEMETVYDLGTKMIDALTKEKVQSGDVITIDKATGKISRIGRSFTRARDYDATGPQTRFVQCPEGELQKRKEVVHTVSIHEIDVINSRTHGFLALFSGDTGEIKPEVREQINTKIAEWREEGKAEISPGVLFIDEVHMLDIECFSFLNRALEDEMAPVVIMATNRGITNIRGTNYTSPHGIPIDLLDRMIIISTSQYKENELREILKIRCEEEDCELSDDALTVLTRIAMETSLRYAIQLITLAGLVSRRRKSNEVEIEDVKKVYSLFLDEGRSTQILSEYQDQYLYDQKPDPSGGGEPMDM

SEQ ID NO: 12450 - protein, 369 aa, Euschistus heros; identical to SEQ ID NO: 12337

SEQ ID NO: 12451 - protein, 236 aa, Euschistus heros
GKSRVPSKMSNLVILKALETAAFWARNVHLVLLGVAPSGYCLVMAAIRKKLVIVGDGACGKTCLLIVFSKDQFPEVYVPTVFENYVADIEVDGKQVELALWDTAGQEDYDRLRPLSYPDTDVILMSFSIDSPDSLENIPEKWTPEVKHFCPNVPIILVGNKKDLRNDPNTIKELAKMKQEPVKPEEGRAMADKINAFDYLECSAKTKDGVRQVFETATRAALQVKKKKRNRKCKLL

SEQ ID NO: 12452 - protein, 1328 aa, Euschistus heros
MNLSLSNYERVPPLDCYQPSGNLIDLADRMLEKFTVEDNNLPQLLDRLQITCESGTTSSGTKDTDYINNVDSSYLSQISQFRLINKIPLPQEISDQFSTLAAGSSGDTSIMGMFPDINRAWMAVESDIYLWNFETGGDVAYFDGLSDPIVSVGLIAPRPGVFQSFISHLLILTTPVEITVLGVILSSSSDRKVGDELQLTPDTIYTLSTDGVPIRVIKGTKNGRIFLGGKDGNLYELVYRKEISWGGKRAWKVNHTKAILSYLVPTFVSGAFSEEDQITEITIDESRNILYTLSIKGSIEVFDLGRNGDTTCRVASLHHSFINRSTVDLIRKSFHFRNMTPPEVSRVVSLCPISENDSPHFGVVGITENGIRLYFTTGSPPRPSTLSLLHARLPPGHAPNTTNVRIGRVAMAIHKSGTFIMVSSMGDYSPDRLWCFTMDGISALKLPLTEFVFTNPQNASIAIAESRENMSLTDRGLHGHFLVYQQNYPQDRFIILSQQGTDIYEKLRPVDIFGELMREKGGPDCEEVKQFFAQHGTDQACAMALILACDQTNQHMAEWATRAFFLYGGDPKYVLQTIQQPVQPPTITNPLQQSILHHTLPLGFKPNTVSTPLGEKQAQPSTRSIETYGVAMSSKHNGLYLFLSRMLRPVWSRRVLDVNYNKKPIYLPTITCEELSLKTVQLYELRSFLTRYTLSSSDVATSLQPANTMTVVSPSGQRTRLQEALIQEKASLDALRNFVERITQVFSLWKLLCEHELPLIVESLSPESQEQLMHITFRELILKGEDLCHELISKLVSLYLNDNASVDPISSKLREVCPLLYKNEDATCTKVNEILQMALEEVDEEAKLNLLRSAIDLCKNVSPNVDIDSVCKSLVKCGYYDGVLEMCQDVASKSDPNSLASKYIARSRPAEDVEGSKAFEARHKAYQQIVHLLDFLYQQCQLGGNNIPPLFGSADLSSHSQKLLEATLEKCLSVDDETCHIVVYDWLVSRELQASLVSLGRPSVERFLSRYPVDSPLRDLLWQYHEKSGNHAAAAQILYKIATAPGEFITLHQRLTYLGKAVMCMRSDGVGCASHLGVFLHELEDLVHVARVQKQILERITSMPDASDINVQDACRKLNANLLSITELYESFAEPFGLWEQKLAILDCAGHDDKELINSIWDNIILKELDQCNSRDPSGQMVVLVSKVRSLGLQFGIQSPCFPIEYLVWQLELISCKLGVDKFHVHNIMTSLGVPYSILLDIYSKMYSANDNCWLESDNEFHLIQVIASFCESFCDNKQLTTSAQERKSTAVQMHDLINECIIVLHSKTGLGELVGYLKSIQTKLERI

SEQ ID NO: 12453 - protein, 1206 aa, Euschistus heros
MSGSDFYGADTLHKEVYIRKGHEDWNEINLNPGGIASTLQDIKTQQKSGAYAYKKIPNRFIYWRTEGNVLEMVEECLDVTLHGNQIRYKFTDSQVLDGLTVTETMKRLIILVPTVSSLHVFTYPHPEKLLKKGFGEVSSLSVFHGISESDATDPQTYHQLNCSSSAIVSCTSCITNNGEAIFALGLANASVLLVNIDSVSGSSSSRILSHDNIVPRFLTGILGKDGGEWVPVSLIFHYIKKELFLFSLCRGGSLRIWSVDRGSFITYLCVKLTSQTTLKAQKHKMCKGYINGTFILHCCVQGAAIVTLAPDYDNGVFNFTTISEIPIQPGFEVTNMCPGEEGYFWCSWLTLDESPAVTKNNVIHPGFSKVALTRPSLQVPVSDYIPRDPASHYLDAIFSSGFFTSLDIAKAISLYKITAVIKPNIDVAEQICAIVETEIYSEIGEQELDDDEFLDIAFRCWNRLYSCCSQYIISSMLPLGMVWLGDYLVLIQECGFSIVVDIEPLELFMTTAVKTSQFPQVGYGCLVEKLRDINLEPGIEKLELSLHTGESIDELSILQEAADLIPPSKQLDDALSIFYEEGLGKNLNSLIEELAVPEDFNKDGSWESFCSYSGVGAVTSAFRDYVTVRLKICEKILLVTELAMRDDDGAADRTQHRSLAALCKAYYILKWICTSKSTGNAPLIHVFSLVNPTSIMQSSLEQCVLGLANCLWPLATNSTLAQHLLSTKQYALLQTLARLVGINSWSLLLAESYILTGQPGKAFDVCLKNAGSDVVHFLNAIRLFEKHSRSDLVIAMATKALELLIVSHSDRETLESALFVHELGMENYDAAWSWIESCSSWSRRSDFLQRLVANMISEGKLTDLISFSYTGLLDELEKLLASRARSLTFGLATNYYNILYAFHVKHENFKKAASVMLEKALRAETAEVQWKCYGACLSSLMLINDPQQAWLVRPNPFSQEDAVEILEIEDIQREFELSGARYNLGGCSPDASQEEVIALCVTQKQYKTALRLANMCKLSCAPCIQAFTASCAALSEQSISWHWLKANEIDDIIITESNATEMLWRILERCIMKYEKKNETVLHRAAANQFLTVGLFIPTWLLQSYKKRNSSELLRLFVQHGYLEEAEELACDYLNAALGIGRENFSIDFPLHLSSPPLCLPLQTIDILLLELKHYNIGERLQKKLDTYISTISRITLERPMTTCKK

SEQ ID NO: 12454 - protein, 966 aa, Euschistus heros
MEISEENLHTLSNYLMQTLSPDPNVRRPAERFLESIEINKNYPILLLHLINKEEIHYTIRVAGAITFKNYTRRNWPINDDNLENKIDPEDRLRVKELIVDVMLVAPSSIQKQLSEAVGTIGKCDFPKDWPGLLTNMVEKFGGGDFHVINGILQTAHSIFKRYRYEFKSQKLWEEIKFVLDTFAKPLTDLAVATQNLTQVHASNPDALRVIYSSLLLISKIFYSLNFQDLPEFFEDNMNVWMPLFHTLLTTDVKCLQTDDDEEAGLLEQLRSQVCSNVALYAQKYDEEFQPYLQGFVTDIWSLLVTVSLQPKNDLLVSNALQFLSTIAERPQYRHLFEDKNVLTGICEKVIIPNIHFRDSDLELFEDNPEEYIRKDIEGSDVESRRRSSSELVKVLAGHFPETVRTIFGARLQEMLAEYSSDPAKWRLKNTAVYIVTSLAERGSTAKHGVTKSSDLVDLHDFAGQYIIPELKKEVNTLPVIKADSIKYLITFRSLLAPQVLIAALPDIVKHLASPSLVVHSYAASAIDKMLTLKQNNQPLITQALLQPIAGDVLTGLFNILNFKGSEENEYAMKAIMRTFYTLDVSVIPFLAELLPKLTQKLTIVAKNPSRPHFNHFLFETISLSIRIVCKNNPGAVGAFEEALFPTFQIIFQEDVQEFVPYCMQVLSLTLARRSPPLPAPYVALYPCLLSPQLWDRPGCVRGLVCLLRSYVRVSSNDDFNQTVKVNGLLGVFQKLISSRLNDHEGFYLMQSLIEHCPRELLDPFMKQVVLLLFQRLTAAKTTKYVKGLITFFCLLVVKYGAPTFIELVDSVQPQMFSMVVERLITPDCRKVSGAVERKVTAIGLCRLVADSKQVFAGPYSACWPALAKSVVEILEAPEDDSVAPEDHFVEVDNLPGYEPAYVHLTAVGSDKHDPIPEITDLRRELANGIRDLFQVSGQVVTQAIASLGEPYASHIKSYLILVGVNI

SEQ ID NO: 12455 - protein, 190 aa, Euschistus heros
MAKVQIGNVLVLDNPSSFLNPFQFELTFECIEELKEDLEWKMIYVGSAESEDYDQVLDTIYVGPIPEGRHKFVFQADPPDVTKIPIEDALGVTVVLLTCCYRGQEFVRVGYFINNEYSDPELRENPPPMPQFDKVIRNILGSEPRVTRFKINWDDSESQDQPSQEAEEQQQATENVGFAENSGHNFMEVS

SEQ ID NO: 12456 - protein, 296 aa, Euschistus heros
MDHMLASPFNLPSIGTPVHQPEEDQQILPIAQQQQQIQPPLQMPPLLPIQSSINQQKPMNTYAPSMGFTTPQSMMHPQTPQNLMSPMVNRMEQTPNNIINPTTPGPMTPMTPSSADPGFMPQLQNIVSTVNLGCKLDLKKIALHARNAEYNPKRFAAVIMRIREPRTTALIFSSGKMVCTGAKSEDDSRLAARKYARIIQKLGFQAKFLDFKVQNMVGSCDVKFPIRLEGLVLTHGQFSSYEPELFPGLIYRMVKPRIVLLIFVSGKVVLTGAKVRQEIYEAFDNIYPILKSFKKQ

SEQ ID NO: 12457 - protein, 160 aa, Euschistus heros
MASVGTTRSVLRLLSSQPILKQAVRGYADEMAFTFAAANKVFYANSNVKQVDVPSFSGAFGILPKHVPTLAVLKPGVVTVFEQDGSSKKVFVSSGTVTINEDSSVQVLAEEAHPVEDLDASAAREQLSKAQADLSRASSELEKAEALIAIEVAEALVAAA

SEQ ID NO: 12458 - protein, 309 aa, Euschistus heros
MPSDEQDKFDGMLLAMAQQHEGIKDLLDTFFSFLARKTDFYVGAQAEAARSLVIDSFEKYQSKANLAAEKKRTESAEAEKKRKERLNAKSTPKVMEITDEEAKKIEEEEKKRKEEESLSKPITEAEGEDEEQDKGKLMPNAGNGADLENYRWTQTLQELEVRVPLKTSFNVRSRDLVVDLGKTHLKIGLKGQEPIVDGELEHEIKIEESTWVIEEGKTLFLTAEKVNKMEWWSKLLTTDPEIATRKINPEPSKLSDLDGETRGLVEKMMYDQRQRELGLPTSDEQKKKDMLKKFMEQHPEMDFSKCKFS

SEQ ID NO: 12459 - protein, 142 aa, Euschistus heros
MTTAWSPDKKHSDRERWICIYPAYLNSKKTRAEGRIISKEKAVENPTYQEIRDVLSAAGLKVGVENKLYSREKSKELLYRGRIRVQLKNDNGTPLNPDFATRESVILHACAMIPKLKTRQGGKHTTEQGQGGTSKKKGKGRR

SEQ ID NO: 12460 - protein, 676 aa, Euschistus heros
MEKPQKMPKVAKVKNKAPAEIQITAEQLLREAKERDLEIVPPPPKQKISDPEELADYQHRKRKAFEDNIRKNRMVISNWIKYAQWEESQRQVDRARSIYERALDVDHRNITLWLKYTEMEMRNRQVNHARNLWDRAVTILPRANQFWYKYTYMEEMLGNIAGCRQVFERWMEWEPEEQAWLTFIKFELRYKEIERAREIYTRFVMVHPDVQNWKRFASFEERHGFISGARKVYERAVEFFGEDIMDERLYIAFAKFEEGQREHDRARVIYKYALDHLPKDRTAEIYKAYTIHEKKYGDRTGIEDVIVSKRKYQYLEEVKTNPNNYDAWFDLLRLVEEEGNIDTIREMYERAIANIPPSREKDMWRRYIYLWINYALYEELEAEDEDRTRQIYRTSLDIIPHKTFTFSKIWLLYAQFEIRHKNLSTARKTLGMALGVCPRDKLYRGYIDLEIQLREFDRCRTLYQKFLEHGPENCITWMRFAELETLLGDIDRARAIYELAVNQPRLDMPEILWKAYIDFEINVGEARNARQLYERLLERTHHVKVWMSYVKFEMTHSQEEEIEPISLARRIYERGNTALRESGEKEERILLLEAWREMEKAHGDEESYKKVEAKLPRRVRRRQAVIAADGSEEGWEEVYDYIFPEDEAVKPNLKLLEKAKAWKKKQETENQTNDED

SEQ ID NO: 12461 - protein, 476 aa, Euschistus heros; identical to SEQ ID NO: 12348

SEQ ID NO: 12462 - protein, 170 aa, Euschistus heros
MNLLKAMSPTSVTPSVELSTYRDQHFKGSRTEQERLLRISTTLYVGNLSFYTTEEQIYELFSKCGDIKRIIMGLDKYKKIPCGFCFVEYYQRADAESSMRYINGTRLDDRIIRTDWDAGFVEGRQYGRGKSGGQVRDEYRREYDAGRGGYGKVMQQPTTKAEAASIFNGQ

SEQ ID NO: 12463 - protein, 313 aa, Euschistus heros
MAAAIGRIYGSRLLKNNPVSKHLQIGSFSTTKSWSRGKKALYTSLGILTGGTGMLIYALEKSLQAGDLELHPPKLPWNHSGYFQSLDHASIRRGYEVYKNVCAACHSLRYVCYRDLVGVSHTEAEAKAEAEEQLVLDGPNELGEMFKRPGKLSDHMPSPYPNEEAARAANNGAYPPDLSYIVPGRHGEEDYIFHLLTGYCDAPAGVVLRDGQYFNPYFPGGAISMAQALYNEIIEYADGTPATQSQLAKDVATFLKWTSEPEHDTRKQMALKVMFIFSLFIAATVYWKRHKWSSLKSRKIIFNPPKSSSPPKL

SEQ ID NO: 12464 - protein, 575 aa, Euschistus heros
MLALQQYGESDSDKEDGEKSPDPNDDALLHLTPLSTGHSSIIQTAICPAPTALPPVEYNPLKFIKPGCTEMTVNLKYEELFAADVGPENPFLTDQQKAPKNILSGYVEEAHMSEFQFENQRKTFQSFGYALDPSIDNMGRTEESLSVVGAVDVAKETNLKTVFESTSKRPLDKRKRNKNDDPSDINGFLGPWGSYVDEKKVVKPEPEVAAELEEYLAKRQKLGKKVEDKPLEEKTVLHIKDPVDYQGRNFLHPPQDVGVNLKSDSPPDKCFIPKSEIHVWKGHTKGISAIRWFPKYAHLLLSCSMDCRVKLWEVYNERRCIRTYYGHRQAVRDVCFNNRGTKFLSAAYDRYIKLWDTETGECISRFTSRKIPYCVKFNPDEDKQNLFVAGTSDKKIICWDLRSGEIVQEYDRHLGAVNSITFVDENRRFVTTSDDKSLRVWEWDIPVDMKYIADPSMHSMPAVTPSPNQKWLACQSMDNKIVIFSALNRFKLNRKKTFTGHMVAGYACTLDFSPDMSYIVSGDADGKAYVWDWKTTKLFKKWKAHDHVCIGVLWHPHEPSKVVTAGWDGLIKYWD

SEQ ID NO: 12465 - protein, 268 aa, Euschistus heros
MVQKKPKKKTGKKVAAAPLAVKKQEVQKVVNPLFEKRPRNFGIGQDIQPSRDLSRFVRWPKYIRIQRQKSVLQKRLKIPPSIHQFSQSLDKQTATQLFKILEKHRPESALAKKQRLKARAEGKIKQKEEVPTKRPNVIRSGVNTVTRLVEQKKALLVVIAHDVDPIELVLFLPALCRKMNVPYCIIKGKARLGRLVRRKTCTSIAVTQMEGNDRTALNKVVEAVRTNYNDRYEEIKRHWGGGLLGSKSAARIAKLEKAKARELAQKQG

SEQ ID NO: 12466 - protein, 334 aa, Euschistus heros
MANMLKDVTIDDKMPNELLLDKHIKFVLAYGANKEEYEFCMTEHLRMSGMYWVLTTLAVTKKLDEVDKKEFIDFIHECTDEKTGGIGACVGHDPHILYTLSAVQIACILRSLDQLPLEKIVSFVAGLQKEDGSFMGDKWGEVDTRFSFCAIACLSLIGRLDAINLEKAVEFVLSCQNFDGGFGSQQNSESHAGLIYCCVGVLSITQNLYRIDADQLGWWLCERQLPSGGLNGRPEKLPDVCYSWWVLSSLTMLGRLHWIDKQLLKKYILASQDPDGGFSDRPGDMPDPFHTLFGIAALSLLGESELTKINPTYCMPQYIIDELNLDPEIMQSQP

SEQ ID NO: 12467 - protein, 895 aa, Euschistus heros
MMLKMNSEATAQLIQILEKTVSPDKNELEAAQNYLEHAAQTNLAEFLQTLSHILHHGGNSPVARMAASLQLKNNLTSKDPNIKAQYQARWLAFPEETRMYIKKNILGALGTENTRPSSAAQCVAYVAVAEIPVGQWPDLIPTLSANVTGPSSTEIMKEATLEAIGYICQEIEHDCLANQSNQILTAIVHGMRSAERSNYVRLAATTALLNSLEFTRANFQQDMERNYLMEVVCEATQSTDTQVRVAALQCLVKIMTLYYQYMETYMGQALFPITLEAMKSDIKEVALQGIEFWSNVSDEEVDLAIEESEAVEMGKPPARTSRYYAKGALQYLVPVVLTKLTKQEEFDDEDDWNPSKAAGVCLMLLATCCEEDIVPHVLPFVQQNIKSPDWRYRDAAVMAFGSILSGLHSSTLKPMVEQAMPTLIELMYDSSVAVRDTAAWAFGRICEIVPEAATNETYIKPLLESLLNGLKAEPRVAANVCWAFTGLAEASYDQAENQVEDGSQPETYILSRYFEYIVHSLLATTDRVDGAQANLRPAAYEALMEMVKNSPKDCYTVVQRATLIILDRLNQVLAMEQQIQSHSDRAQFNDLQSLLCATLQSVLRKMTPEDAPQISDTIMNALLQMFNSNSCKSGSVQEDAIMAVSTLVEVLGDGFIKYMPAFQPFLCMGLKNHAEYQVCCAAVGLTGDICRALKNKVLPYCDDIMRLLLENLSDNSVHRSVKPQILSTFGDIALSIGADFKKYLDVVLHTLMQAAQAQVDTSDFDMVDWLNELREGIVEAYSGIIQGLKGEDNNTAASAANLALLEPHIPVMAQFLTCVSRDTSKQDKVLAGSAGLVGDLCSAFGAKVIPLLDIDPITELLTQGRRSRINKTKAVSNWASKEMRRYKATIANAAS

SEQ ID NO: 12468 - protein, 501 aa, Euschistus heros
METILEQQRRYHEERERLMDAMVKEMLHKKSSYREQINSDHRLKMLLDQYMESTHKLKELYEDKDGIRKDEVAALSGPNEFSEFYSRLKTIKEFYRRIPNEISVPMSVEFEELAKLRENPTEETSNLVEFTDEEGYGKYLDLHECYEKYINLKGVEKGDYITYLTTFDRLYEIPKDRKSSEYKRYVIMLLNYLCDYIARIKPLLDLDQELNNVHKDFTSQWEAGTFPGWPKETGSVLSNVGAHLDLSAFSSPEELASLGLDRLKSALMALGLKCGGTLEERAQRLFSTKGKKSLDPNLLAKSKPGKSNRERDLERQRDIAFLEAQVYKLAELLSEQRAATKENVQRKQARTGEERGDSEGEASSSGSESEGEDDGVPYNPKNLPLGWDGKPIPYWLYKLHGLNISYNCEICGNFIYKGPKAFQRHFAEWRHAHGMRCLGIPNTAHFANVTQIEDALALWEKLKTMKHDERWQPEHEEEYEDSLGNVVNRKTYQDLKRQGLL

SEQ ID NO: 12469 - protein, 211 aa, Euschistus heros
MTVGKNNKMLQHINYRVRIILQDSRTFIGTFKAFDKHMNLILGDCEEFRKIKPKNTKQPEREEKRVLGFVLLRGENIVSLTVEGPPPPEEGLPRVPLPGAGGGIGTARPAGRGVPAPGTPAAPGLQGPVRGVGGPSAQVMTPAGRGGQVSAPPQMRAPPPGMPPMMGAPPMMNMAPGMAMGRGGPPPQMGAPPAPPMRGPPPGMMRGPPPF

SEQ ID NO: 12470 - protein, 299 aa, Euschistus heros
MNSVEKALLVSLLYYRWKRRTRNRKIWIHPIVEKRKEKGHFYNLYSELRNHPDQFFNYSRMSMCSFDELLGLIKDQITKNDTRMRSCIPPEEKLIITLRYLASGCSLADLRNNFRVGKSTAGVIVREVCNALWICLREITMPPLTNDRWLEIAKGFETWAGFPNCIGAIDGKHIRMKQPCNSGSMFYNFKNYFSTVLFAMCDANYCFTYIEVGSYGKSSDSGIFKNSLLYKKMCDGSLQIPAPRSFDNNSSEQFSYVIVGDDAFPLSDNLLKPYGGPRLSPDKQIFNKRLSTARRYIES

SEQ ID NO: 12471 - protein, 683 aa, Piezodorus guildinii
MSSKHKHKKYEEKEERRKKHKSRYSDDSEDEEKCSSSRNRSKKKKSDHSRKHKKEKKKKSRRSESSDSSTSSDSSSDNSVKLLKRLHDKHEKMIQQKKKEKELMKANETPEEKRIRRLLKKEAKERKRKQRMGWDKDYLHYTNTDNPFGDANLLSTFVWSKKLAKDGLTDVSREELERINRIKQEENKIELEKVKKRRQEREQERQEREEAMMRMQREKEAEQFEAWATQEDQFHLEQARLRSRIRIADARAKPIDLLAKYINSEEEVDAVEMHEPYTYLNGLSIKDLEDLVEDIKVYMKLEKGKNLDYWNDITVIVEDELYKLRKMGKKSDYEAAVGRREGIHESVAKEVSSVFRGKTASQLAAMQKQIEKKISDKGEGIDIGYWESLLSQLKAHMARARLRDKHQENLKQKLELLKAEQRQQEQEIKEEPIDESEHQETMSREEIKEEREDSDEEHSGGDEDAGESMLKESFGEYEAGAYSPVYVDPASLEPGTLIIGEEEDAQRLEYARQHLTSQESQVGATSEELAMQREARKGMSSDEAIFSVESALDSQVYLWSDKYRPRKPRYFNRVHTGFEWNKYNQTHYDMDNPPPKIVQGYKFNIFFPDLIDKSATPEYYLTTCPDNPDFAVLRFHAGPPYEDIAFKIVNREWEYSYKRGFRCQFHNNIFQLWFHFKRYRYRR

SEQ ID NO: 12472 - protein, 402 aa, Piezodorus guildinii
MGDANIIDKSMRSVFVGNIPYEATEEKLKDIFNEVGPVLSFKLVYDRETGKPKGYGFCEYKDQETALSAMRNLNGYEIGGRSLRVDNACTEKSRLEMQSLLAGPPIDNTYGESVESDKAPEAISKAVASLPPEQMFELMKQMKLCIQNNPTEGKAMLLQNPQLAYALLQAQVVMRIVDPQIAITMLHKANPSVPPLQPPPVEAIRPVPVPQPAPAVAPPPVVPPVVQARPVVEPEWVPPARPHQPPHPPTFIPQPGGDLDMRTLDPRVPPVRLTQDQDLRIPPMVPAPQQPPTQPPQPYPQEHVISSTVRDPRQYRDPRTGAATVPVPPRPIVTQAVIPPRPVAPPTSHITSALPPAASDQEKAALIMQVLQLSEEQIAMLPPEQRQSILVLKEQIAKSTQR

SEQ ID NO: 12473 - protein, 395 aa, Piezodorus guildinii
MTASQAMEPNREKALQDYRKKLLEHKEVEVRLKEMRDQLKDLTKQYDKSENDLKALQSVGQIVGEVLKQLTEEKFIVKATNGPRYVVGCRRQLDKLKLKSGTRVALDMTTLTIMRHLPREVDPLVYNMSHEDPGDVTYSAIGGLAEQIRELREVIELPLLNPELFQRVGITPPKGCLLYGPPGTGKTLLARAVASQLDANFLKVVSSAIVDKYIGESARLIREMFNYARDHQPCIIFMDEIDAIGGRRFSEGTSADREIQRTLMELLNQMDGFDSLGQVKMIMATNRPDTLDPALLRPGRLDRKIEIPLPNEQARLEILKIHASPISKHGDIDYEAVVKLSDNFNGADLRNVCTEAGLFAIRAEREYVMQEDFMKAVRKVADNKKLESKLDYKPV

SEQ ID NO: 12474 - protein, 258 aa, Piezodorus guildinii
MARRYDSRTTIFSPEGRLYQVEYAMEAISHAGTCLGILANDGIILVAEKRNTNKLLDESVYSEKIFKLNENMICSLAGITADANVLTNELRLISQRYLLQYGETIPCEQLVSWLCDIKQAYTQYGGKRPFGVSILYMGWDKHYGYQLYQSDPSGNYSGWKATCIGHNSGAAVSSLKTDYKEGEMTVKDALALGIKVLSKTLDTAKLSVDRVEVATLSQKNGKCVTSILPPDEVQELINAYEKSEAEANALKKEKTPKS

SEQ ID NO: 12475 - protein, 880 aa, Piezodorus guildinii
MTKIQEPQQEEMSEEDKRLQEELNMLVEKITGPDIHLYVPALESMRDLIRSSTTSMTSVPMPLKFLRSHYGALKEACAVMADKKAQELCASIVSVLAMGQDLPGSRECLKYCLQSHQKDVGDWGHEYVRQLEGEIADEWASTEEKDKLLGLVESIIKFDMEHNAEIQACDLLMEIDRLDMLDKHMDMTNYSRVCLYLINCAVYVEEPERGNIVSGVMKHYMRFKEYPRALCLAMQLNKQDIMLDIFNQCQDPLVRKQLAFMVGRQQLSLELSDDLPDKSDLTNIMSNAHVNDHFHSLGRELDIMEPKTPEEVYKVWLEGLVLRPTYNLEVPLDSARHNLASTFVNAFVNAGFSRDKLVSVEDGNKWMYKNKQHGMLSAAASLGLIHLWDVDGGLTPIDKYLYTSEDYIKSGALLALGIVNCGVRNDCDPALALLSDYVLHESVTLRIGAVLGLGLAYVGTKRQDAITLLLPVLSDSRSTPEVVAMAALACALITLGTPHPDVVSTILQTLLDLPVAEMTDGHYSKFLPLALGLCYLGQREGTEATKAALEALPEPLRSLSQHMLKMCVYAGTGDVLVIQEQLQVCSEHYPTPEEKKETDKKDKDKDKDKDESKSSKVKDMTCMQAVAALSVAVIAMGEETGSEMATRIFAQLGRYGEPAVRRAVPLAIALSSISNPQLAVIDVLNKYSHDLDEEVAHNAIFSMGLVGAGTNNARLATMLRQLAQYHAKNTGHLFMVRIAQGLTHLGKGTLSLCPFHTDRQVMNYSAVAGLLITLVSFLDTKTIMLGKSHYLLYTLATAMYPRWLVTLDEHLEPLPVSVRVGQAVNVIGKAGTPKTIAGVHTHTTPVLLAVGERAELATEDYTPLTPVMEGFVILRKKQPA

SEQ ID NO: 12476 - protein, 447 aa, Piezodorus guildinii
MAEVLRPEYWWFQNMEPPAAEQVQAQQQQQEQQEPGVIRQRTITTSGTITTSPQHETTPSPEQPVQEQGNKEVEVPYEIVQLRPGTYDETYSLEETARYSPGSGRYYTTEGTVKYERDDKGEGSYVTLEPVNYPPGGAYQEPATGYYTYKEEEDVYIKADPPLTPKNFAHFDHPVTSHPTQLSAQVTYVTGGGSREYVTTNQPGYWSSEYVYQQPQQEIQLPPGTPYVFSSNGQATWAIDESYDPSMLSTSDIKECVNCAASVTPLWRRDGTGHHLCNACGLYSRINGVHRPPVRTHHKKVHNIGNRRNGVSCANCQTNNTTLWRRNNTGEPVCNACGLYFKLHGVNRPHTMKKEGIQTRKRKPKNPQVNLPSPKNDIKTTGEKSGSWDKCDNDLLDSGYTMATSSIFLPSSFLTKPVGVSVSGLESVPPSVIIPPTSSQETQRPEQ

SEQ ID NO: 12477 - protein, 1834 aa, Piezodorus guildinii
MSLPGGKMACPGNGIYVIQGEMSVLLTAMKKVNRWSSHVHQDDENDILIRSFTDLKDVLNQIGDLREVEPNHFLSPFLEVIRSEETTGPVTSLALSSVNKFLSYGLIDSKSKTIAATVENIAEAVTRARFVGTDQTNDSIVLLKILQVLRTLLLSPEGCWLTNESVLEILLSCFRMCFEPRLNELLRRCAENCLRDMVQLLFSRLPSFTEDNRKIQQKLKMNTSAPLDAGKGKRKTSRPSSRKVSRKSQEISPSPVLGLEGSNASKECDIQQMALRDEPEITSHDKSEPEILPVPSEESLAKVSSIDSLETNVANGISNGTKSEEHQNSTSPVILDDGVVISIEDSSSQNSESTEQLAAIGNVSEIKRPDELDLNSAETNFASPSSDSKAEEEPLLSPTTPENIMEGQDWTNQQGVRFTNTEADNLTPSGPYGLLSVHELLRFLASLCNPLDKQNSDSMIHIGLTLITVALEVGADSIANFPSLLSTVKNDVCRSLLALLNTEKLPIFASVLQVSFLLFESLRTHLKFQLERYLSRLTEIIVSDSSKISYEHREIALESVVHLWRIPGLVTELYLNYDCALYCPNLYEELTNLLSKNAFPVTGVYNTHLLSLDALLTVIDSIESHCNSRILNERQNPSKDGEINKLEFHDFASNYIHRTGTRQKLSLNIPSHEQLMAVKRKKKLLATGTEHFNSKPKKGIQFLQEHNLLSTPLDAVEVVGFLRENPHLDKKMIGEYISNRANIAILDQFVKSFDFTEMRIDEALRLYLETFRLPGESPLISLVMEHFAEHWHKCNGEPFANADAAFTLAYAIIMLNVDQHNHNVKKQNTPMTAEAFKRNLKNVNGGQDFEEEMLDDIYNAIKTDEIVMPAEQTGLVKENYEWKVLLRRGSGSEGYYVHAPNGLLDHDLFSLIWSPTISALSYLFDKTNDPTIYQKAISGFRKCAMISAHYGMSNDFDNLIVSLCKYTMLHYTSESPENLTISFGSSPKARRAAKTVFDLAHRHGDIIRESWRNILDCILQLYRCKLLPKILVEAEDFIELSGKISLIREDIQLSPKTETGILSSLYSYIALGAETNTQKGPSVEDQEAIKVAQNCIRECHLEQLITESKFLRIDSLQHFVKALVTASYGPEGHVSLGTSYSEDTAVFFLELLLKVVIQNRDRISSIWCSVKEHIYTLLMGAAACDHHFLVERSVVGLLRLAIRLMHKEEMGPMVLQSLRMLLLLKSSTLSRVSRQISYGTFELLKTSAANIHSATDWAIIFTLLECVGAGAPPPKVVSKPVSSTESGARSEGEVQVDSGLGNERGYTSDSELSKAGSVPLSPSLSPEAPLSNTPTGWILVGREGEIQPVSCVRRGMLPELSRYDPLSMVKCVDSLSFLVRDVVHITPYNFHDCIRCIRTFVEAAANTVERKSRKAGRDTARQSKRKNTKRREERGLSPTGSAYDADESDPEDSPGYQQVCIQLLELMHTLHTRTAQIFRWWAEETGQKEVSNPSYWTPGWCPLLQGISRLCSHPNRAVRMSAITYLQRALLMQDLQSLSGEEWEECFTQVLFPLLSTLLAVNIPAIEETRIRAATVLSKVFLHHLSPLQTLSSFAQLWLTILDYMDKYMHADNSDLLYEAIPESLKNLLLVMDSAGVFNGLDGRNEIWVVTWDRISSFLPNLQSDLFKDHLPVVDASSLETKEALETSKGEIEVVQTEQPTMQRPPTSQVVQSPPQPPSMPKPGEAVEISGPTTNNNVGSQNWQPPAPVYPHLEQMVSTPIGPSSQLPVYSGFASMPHQPPPPSAQFFYQDMSSPSQPNATLNSEQPAVGGSLLLASAEMEPPKLPVISPPTSS

SEQ ID NO: 12478 - protein, 205 aa, Piezodorus guildinii
MSILAYNGSAVIAMKGKDCVAIASDLRFGIQGQTVSTNFEKVFEMGPHLYIGLPGLTTDTFTVLNKLNFRKNMFELKEDRKIAPDVFLSMVSNLLYERRFGPFFVEPIIAGLKPKTMEPFIASMDLLGCPNKPEDFVVAGTASEQLYGMCEALWEPNLGPEDLFETISQALVNACDRDALSGWGASVYIIEKDKVTHRRIKTRMD

SEQ ID NO: 12479 - protein, 925 aa, Piezodorus guildinii
MESPPSLETVHQAVYALYHNPDPAEKEEASLWLGQLQKSVFSWKIADEILHTSSDVECCYFAAQTMRTKIQHSFHELPPESHLPLRDSLMDHISKINESTNSVIGTQLYLALADLALQMGSWEKPAIDLIERFSMTSVPPLLEMLTFLPEEINSRALRLGSNRRQELLHKFSLAVPNVSEFLKMCLNNSGNNPQIQIKVFKCFTSWVSVQAMTLNDVTDNIVVATAFHVLANRMASSNLHEAAADCVCSLLECLEDNNNQQSIEMQLFNGVISLEQPFHISVAHEEHEKCVNYCRVFTELAESFLEKIVSGSSPTKAHFAIKIFDLVLTCVGHHDYEVAAITFNLWYRLSEELYQKKNSGLTSLFKPYIERLIEALCRHCQMEPDHEGILEEGDDFPDFRMKVAELIRDVVFIIGSSNCFRQMFLSLQGPNTTWDTTEAALFIMQAVAKNIIPEENDVVPKVVEAILNLPPNTHIAVRCTSVLLLGELCEWIEKHPQYLEPVLNMVLFCLQQPQLANSAANCLQSICSTCKNQMVTKFLGLLQILQSLDKFVLTNESVVGLLKGVASILSIMQHDQLQQAMRDVCLIQIKPLVHLIENDVKLDKGTKSDPAIWMDRLSAIFRHINITVRNGEIHPCQPVITEIWPVLSSVCTKYQANSHVMERCCRCLRFVVRCVGKQSANLLEPLVKQIVTLYAQHEHSCFLYLGSILVDEYASEQGCIQGLIDMLQAFIHPTFTLLQGEAGLKLHPDTVDDLFRLCARFLQRAPVPFLTAPAINSIMECALSCIPLDHRDANSSVMKFFYDLIHAGMTNEDHEDFSLRQRLVQNIIQERGSDLVNNLLTASVFFLQIYMLSDVADVLMELILFDKQSAGRWVEQALKRMPTHNSTGSITATPKQLEDFHRSLLSASSSKTLTTTLKEFSRLYR

SEQ ID NO: 12480 - protein, 510 aa, Piezodorus guildinii
WTFWRSRGSASKMAQRFPPSQPAPSPVQQPQRYPSPSGPPLRQYAPSNFPLQQRPGGFVQGGGMGSGMMPRPQQQPYNPIRPPIPQAQKRPSDVRPPQQQPKGEFPHTSAGGSSGKKKKKLADKILPQKVRDLVPESQAYMDLLAFERKLDSTIMRKRLDIQEALKRPMKQKRKLRIFISNTFYPAKEATETEEGSVASWELRVEGRLLEDSKNDPNKPPPLQVKRKFSSFFKSLVIELDKELYGPDNHLVEWHRTPTTQETDGFQVKRPGDKNVRCTILLLLDYQPLQFKLDTRLARLLGVHTQTRPVIISALWQYIKTHKLQDPHEREYINCDKYLEQTFSCPRMKFAEIPQRLNPLLHPPDPIVINHIISVEGTEQKQTACYDIDVEVDDTLKTQMNNFLLSTASQQEIQSLDNKIHETVETINQLKTNREFFLSFAKDPQQFINKWIISQTRDLKTMTDVVGNPEEERRAEFYYQNWAQEAVCRYFYTKVQQKRAELEQALGIRNT

SEQ ID NO: 12481 - protein, 144 aa, Piezodorus guildinii; identical to SEQ ID NO: 12255

SEQ ID NO: 12482 - protein, 342 aa, Piezodorus guildinii
MKVLLESDVQLTTHFWGASDYKDKLSVAIGEPLVASSDASWANHILLGHPAMPTATGHSGVIPSNEECGIRDVWAHNLKDEFKVIRKIIHKYNYVAMDTEFPGVVARPIGEFRSTADYQYQLLRCNVDLLRIIQLGLTFLDENGKAPAGPYSTWQFNFKFNLAEDMYAQDSIDLLQNSGIQFKKHEEDGIDPVDFAELLMTSGIVLMENIKWLSFHSGYDFGYLLKLLTNQNLPNDESEFFELLKIYFPTVYDVKYLMKSCKNLKGGLQEVADQLELTRVGPQHQAGSDSLLTGMAFFKMREMFFEDNIDDGKYCGHLYGLGASFVVNGNSFHDNGDNSSNS

SEQ ID NO: 12483 - protein, 401 aa, Piezodorus guildinii; identical to SEQ ID NO: 12257

SEQ ID NO: 12484 - protein, 532 aa, Piezodorus guildinii
MTNAAGDGHRSHSNVYKDKSKPQDVRSSNMTAAKGLADAIRTSLGPKGMDKMIQKGNGEVTITNDGATILQQMNVTHPAAKLLVELSQAQDVEAGDGTTTVVILAGAIMEAAEKLMNRGIHPTTISDAFSIAVEKAMPILREMSIPLQQNDNESLIRSASTSLNSKVVSQHSSILAPLAVNAVLRITDPKKDKNVDLKDIKIIKKLGGTVEDTELIEGLVFTQKLANINGPKRLEKVKIGLIQFCISPPKTDMDHNVVISDYAAMDRILKEERAYILNIAKQIKKAGCTMLLIQKSILRDALSDLAIHFFDKLKIMVVKDIEREDIDFVCKTLGCRPIASLDHFTSEALVTAELAEEVSAGSSRIVKVTGIHNPAKTVTILVRGSNNLVLEEADRSIHDALCVIRCLIRERALLPGGGAPEIELSLRLGQHAQVLGSVEAYCLREYAKALEIVPYTLAENAGLNPVATVTELRNKHVHGQTSAGINVRKGQVTDILEENVLQPMLVTASAITLATETVRSILKIDDILNVAH

SEQ ID NO: 12485 - protein, 415 aa, Piezodorus guildinii; identical to SEQ ID NO: 12372

SEQ ID NO: 12486 - protein, 162 aa, Piezodorus guildinii; identical to SEQ ID NO: 12260

SEQ ID NO: 12487 - protein, 321 aa, Piezodorus guildinii
MKMEVENMISIEMEDKTSLKELDQWIEQLNECKQLTESQVKTLCDKAKEILAKESNVQEVKCPVTVCGDVHGQFHDLMELFRIGGRSPDTNYLFMGDYVDRGYYSVETVTLLVALKVRYRERITILRGNHESRQITQVYGFYDECLRKYGNANVWKYFTDLFDYLPLTALVNGQIFCLHGGLSPSIDTLDHIRALDRLQEVPHEGPMCDLLWSDPDDRGGWGISPRGAGYTFGQDISETFNHSNGLTLVSRAHQLVMEGYNWCHDRNVVTIFSAPNYCYRCGNQAAIMELDDAQKYSFLQFDPAPRRGEPHVTRRTPDYFL

SEQ ID NO: 12488 - protein, 322 aa, Piezodorus guildinii
DGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHL

SEQ ID NO: 12489 - protein, 542 aa, Piezodorus guildinii
MQPQIILLKEGTESSQGKPQLVSNINACQIIADAIRTTLGPRGMDKLIVDGSGKATISNDGATILKHLDIVHPAAKCLVDIAKSQDAEVGDGTTSVVLITSEILKQLKPYVDEGVHPRIMMKAVRKATQLCLDKINSLAVKIEKSSAEQHRSLLERCAATALSSKLIHQQKEFFSKMVVDAVLLLDELLPLDLIGIKKVPGGALEESLLVSGVAFKKTFSYAGFEMQPKKYTNPKIAILNIELELKAERDNAEIRLDNVEEYQKVVDVEWQILYEKLDTIVKSGAQVVLSKLPIGDVATQYFADRDMFCAGRVADEDIRRTQKACGGTMITTTKDMSASVLGTCELFEEKQIGGDRYNLFAGCPNAKTCTMILRGGAEQFLEETERSLHDAIMIVRRTIKNDAVVAGGGAIELELSKMLRDYSRTIAGKEQLLIGAVAKALEIIPRQLCDNAGFDATAILNRLRQKHAQGSCWEGVDVTLEDISDNMEKCVWEPSVVKRNALEAACEAVCLVLSVDETIKNPKSGGGGMGDQPVMPPRGRPM

SEQ ID NO: 12490 - protein, 4644 aa, Piezodorus guildinii
MTDSLESNDPPPEEQPVSIIDITDFLDYLRENVKLNLLGVKSVPPALDTALDDNGNLDCIKKFLSDPQIATLIVQKNSTKDDDPEQSGEGEDEKETPTISISNMVQFSSPKASSLLFMKNGAIMDADKSIQSQLHMIEFSEGTAYESLHAIISKGMSPYFKSYVKESGRADRDGDKMVPSVEKKIDELEMGLLHLQQNIDIPEITLVVHPIVSNVIKKCAEEGRKPKVADFGDRVEDSTFLNQLQHGVNRWIKEIQKVTKLDRDPSSGTALQEISFWLNLERALHRIQEKRESIEVGLTLEILKHGKRFHATVSFDTDTGLKQALATVNDYNPLMKDFPINDLLSATELDRIKLAVQQIFTHLRKIRNTKYPMIRGLRLIEAISRDLTTQLLKVLGTRRLMHIPFDEFEKVMQQCINVFVTWDDEYEKLQNLLRDIVKKKRDEQLKMVWRVMPAHKKLQTRMEQMRKFRHQHEQLRTVILRVLRPVPASLINGQEVTGQDKVVDDAPNISAVEEVNLAYENVKEVDCLDMSKEGGEAWEAAVARYEEKIDKVETRITAHLRDQLGQAKNANEMFRIFSRFNALFVRQHIRGAIREYQTQLIQRVKDDIEALHEKFKVQYGQSKGCRMSSIRDLAPVSGSIIWVKQIDRQLTTYLRRVEDVLGKGWENHIEGQALKSDGDSFRLKLNTQEIFDDWSRSVQQRNLSVSGRIFAIESTRSRSGRGNLLKLKVNFLPEIITLYKEVRNLKNLGFRVPLAIVNKAHQANQLYPFAVSLIESVRTYERTLEKLDDKASIIPLVAGLRKEMQQLVAEGIQLVWESYKLEQYVHRFAEQVCTFQEKVEDLLVVEEQLDVDVRSLETCPYSASTLRDILAKVQHAVDDLSLKQYSNLHIWVSRLDQAVEKNLGGRLQAGIDAWTDALEGKSHELDLSMDTDAPARPTHAPGGDPHVQTVTHEVRITNQIMYLYPSIEEARFQIMQQLFQWQAVVTSQQRLQSSRYQLGLERLISQSYRDLLTKLPNGSQALINAYDSIDRKIKDVVNYVDEWLRYQSLWDLQSDTLYSRLGDDITMWMRCLSDVKKSRTTFDTSETRRQFGPIAIDYAKVQSKVALKYDSLDKEILAKFGGLLGQEMSGFHSQISKSRSELEQQSIEAASTSDAVCFITYVQSLKRNMKSWQKQVEIYREGQRILERQRFQFPNNWLHVDNVEGEWSAFNEIIKRKDLSIQAQVVSLQQKMVAEDRAVEARTNDLLSDWEHSKPIEGRLRPDEALAQLNEFEVKFARLKEERDNVAKAKEALELQYTGASSGSEERVAVVFEEMEDLKEVWTELSGIWRRLDETREIPWLSVQPRKLRQQLDGLSQQLKELPARVRQYSSYEYVKKLLQGYTKVNMLIVELKSDALKERHWRALMRKLRVNWVLSELSLGQVWDVDLQANESVVKDIILTAQGEMALEEFLRQVRESWQNYQLDLINYQNKCRLIRGWDDLFTKVKEHINSVAAMKLSPYYKVFEEEALTWEEKLNRINALFDVWIDVQRRWVYLEGIFSGSADIKTLLPIETSRFHNISSDFLGLMKKVAKSPMVMDVLNIQGVQRSLERLADLLEKIQKALGEYLERERMSFPRFYFVGDEDLLEIIGNSKNIARLQKHFKKMFAGVASILLNEDNTIITGIASREGEEVIFTNPVSTVDHPKINEWLSLVEKEMRLTLAATLVSAVGELRGFKDAPLDPPNYMAWVDRYQGQIAVLAAQVLWSEDVEAALGGKSGGLQGVLTQVEGTLTVLADCVLHKQPPLRRRKLEALINEFVHKRTVTRRLIQANISSPKSFEWLCQMRFYLDPTQTEALSQLSIHMANAKFYYGFEYLGVQDRLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQIQTIQEALKYHMDSNNRDSTLTVELVGKQVRVSPDMAIFITMNPGYAGRSNLPDNLKKLFRSLAMTKPDRQLIAEVMLFSQGFRSAEKLASKIVPFFKLCDEQLSNQSHYDFGLRALKSVLVSAGNVKRDRIQRIKEKREGGSGDEATIAENLPEQEILIQSVCETMVPKLVAEDIPLLFSLLNDVFPQVQYTRAEMTKLKEEIRKVCQEEYLVCGEGDEQGGPWMEKVLQLYQISNLNHGLMMVGPSGSGKSSAWRVLLKALERFEGTEGVAHVIDPKAMSKEALYGVLDPNTREWTDGLFTHVLRKIIDNVRGEINKRQWIIFDGDVDPEWVENLNSVLDDNKLLTLPNGERLSLPPNVRVMFEVQDLKYATLATVSRCGMVWFSEDVLSTEMIFENYLSRLRHIPLEEAEEESSFPQLKKIGGERKEEGISPAMQVQTDVANILQSYFSPDGLVVRCLEYALKQEHIMDLTRLRALGSLFSMLNHGVRTVIQYNQSHSDFPLPSEQLDRYIPKVLIYSLLWSFGGDAKLKVRSDLGDFIRSVTTIPLPPNNPNIPIIDYEVNISGEWSPWSAKVPQIEVETHKVAAPDVVVPTLDTVRHESLLYTWLAEHRPLVLCGPPGSGKTMTLFSALRALPDMEVVGLNFSSATTPELLLKTFDHYCEYRKTPNGVVLAPVQLGKWLVLFCDEINLPDMDSYGTQRVISFLRQLVEQRGFYRSSDLAWVSLERIQFVGACNPPTDPGRKPLSHRFLRHVPVIYVDYPGETSLKQIYGTFSRAMLRLIPSLRGYAEPLTNAMVEFYLSSQERFTQDMQPHYVYSPREMTRWVRGICEAIRPLDSLKVEGLVRLWAHEALRLFQDRLVEASEREWTNENIDKVALKHFPSVDKESALGRPILYSNWLSKDYIPVERDQLRDYVKARLKVFYDEELDVPLVLFDEVLEHVLRIDRIFRQPQGHLLLIGVSGAGKTTLSRFVAFMNGLSVFQIRVHNKYTSEDFDEDLRSVLRRSGCKNEKIAFILDESNVLESGFLERMNTLLANGEVPGLFEGDEYSTLMTQCKEGAQREGLMLDSNEELYKWFTGQVMRNLHVVFTMNPSHEGLKDRAATSPALFNRCVLNWFGDWSDGALYQVGREFTNTLDLDGPPTWKAPDFFPIAYANLPSPPNHRQAVINGCVFVHQTLHKANQRLAKRGARTMAITPRHYLDFINHFVKLYREKCSELEEQQLHLNVGLGKIAETVEQVEEMQKSLAVKSQELQAKNEAANAKLKQMVKDQQEAEKKKVQSQEIQSQIEKQKLLIAQKREGVMADLAQVEPAVIDAQQAVKEIKKQQLVEVRSMANPPAVVKLALESICLLLGESATDWKSIRAVVMRDNFINSIVNNFSTENISDEVREKMHTRYLSNPEYTFEKVNRASMACGPMVKWAVAQISYADMLKKVEPLREELRSLEEQAGENEQKGEDTKALIAQLEKSIAAYKEEYAQLIQEGLAIKQDLENVQAKVDRSIALLKSLGLERSRWEATSETFKSQMATIIGDVLLSSAYLAYAGYFDQHSRHNLLSRWTEHLSSAGIQYRQDIALTEYLSNPDERLRWQANSLPTDDLCTENAIMLKRFNRYPLIIDPSGQATEFIMNEYRDKITKTSFLDDSFRKNLESALRFGNPLLVQDVENYDPILNPVLNREVRRTGGRVLISLGDQDIDLSPSFVIFLSTRDPTVEFPPDICSRVTFVNFTVTRSSLQSQCLNQVLKAERSDIDEKRSDLLKLQGEFHLRLRQLEKSLLGALNEAKGKILDDDSVITTLETLKQEAAEISKKVEETDRVIGEIETVSQQYKPLSQACSNMYFTLDSLHQIHFLYQYSLKFFLDIFSAVLFSNPSLDGLTDHTQRLGVITKQLFAVCYERVARGMLHTDRLTLALLLSRIYLRGLPQEDQLEAEFHHFLRGKEGVVASGGGASHLEGLSSDQLEALIRLSNRLPQFKELMKKVNEMPEFVAWLQQSTPEQNVPTLWHEDKPLSSIATAMNRLLLIQAVRGDRVTAAGAGLVSAVLGEGFTARAERELDLAHIVESEMTAGVPVLLCSVPGFDATSRVDDLAAESGKQLASIAIGSAEGFSQADSIINMAVRSGRWVLLKNVHLAPQWLVQLEKKLHSLQPHSGFRLFLTMEINPKVPVNLLRAGRIFVFEPPPGIRANLLRTFSTVPASRMMKAPSERARLYFLLAWFNAIVQERLRYAPLGWAKHYEFNESDLRVACDTLDTWIDATAVGRTQLPPEKVPWDALVTLLSQCIYGGKIDNDFDQRLLSSFLSKLFTPRSFEADFALVANVDAGAPGGQRHITMPDGTRRDHFLHWIESLADRQTPSWLGLPNNAEKVLLTNKGTDLVIKLLKMQQLEDEDELAYTEQESGPPSSLQPGPDPGRPAWMRTLHNSALTWLQLLPTSLQTLKRTVENIKDPLYRYFEREVNSGAKLLRDVIHDLTDVVAICQGEKKQTNYHRTMLSDLVRGILPSGWRRYTVPRGCTVIQWITDFSNRVKQLDTISQLASQRGPSEIKNTPIWLGGLMNPEAYITATRQCIAQANSWSLEELILDVTIPEPSSNSSVATDECSFSVTGLKLQGAQCRNNQLLLTSTIMMDLPTTLLRWHRAGGEGDSGKLSLPVYLNSTRSELLFTVDLNIAPGQEPHSFYERGVALLTSTALN

SEQ ID NO: 12491 - protein, 879 aa, Piezodorus guildinii
MAKSSPESSDSEEDRKQRDEFAARLRKKDKENTRKMTTIHSDKRAYEEAAKRLKIDSEHQEKLIPRLRVESRRKYLEKRKEDKVLELEADIIDDEYLFNEDELTERERKDRDHKKKLLVLAKEHERARELEKVQRYHMPRDVKDSVEQYEEVDERENKPNYEQRKWEEEQMSSAVFHFGAKQKDKYQEEYDLVLDNQIEFIQAMSLAGTKEKPEQQLTEKERKRLTIEETQKSLPVFKFKDELVQAIKDHQILIIEGETGSGKTTQIPQYLYQAGFTNDGKKIGCTQPRRVAAMSVAARVAEEMSVKLGNEVGYSIRFEDCTSERTVIKYMTDGTLHREFLSEPDLQTYSVMIIDEAHERTLHTDILFGLVKDIARFRSDLKLLISSATLDAEKFSTFFDDAPIFRIPGRRFPVDIYYTKAPEADYIDACVVSILQIHATQPLGDILVFLTGQEEIETCQEILQDRVRRLGSRIKELLILPVYSNLPSDMQAKIFQPTPPNARKVVLATNIAETSLTIDNIIYVIDPGFCKQNNFNSRTGMESLIVVPVSKASANQRAGRAGRVAAGKCFRLYTAWAYKHELEDNTVPEIQRMNLGNVVLTLKALGINDLINFDFLDPPPHETLVLALEQLYALGALNHHGELTKLGRRMAEFPLDPMMGKMLLASEKYKCSEEIVTIAAMLSVNGAIFYRPKDKVVHADTARKNFFLSGGDHLVLWNVYKQWADTDFSTQWCYENYIQYRSMKRARDVREQLVGLMQRVEMDLISNPTDSIAIRKTITSGYFYHIARLSKGGHYKTVKHNQTVMIHPNSCLFEDLPRWVVYHELVFTTKEFMRQVAEIESKWLLEVAPHYYKPRELEDSTNTKMPKVLGKTRAQLGEH

SEQ ID NO: 12492 - protein, 456 aa, Piezodorus guildinii
MKIEEVKSTVKTQRISSHSHIKGLGLDENGVPIQMAAGLVGQENAREAAGIVVDMIKSKKMAGRAVLMAGPPGTGKTAIALAMAQELGNKVPFCPMVGSEVFSSEIKKTEVLMENFRRAIGLRIKETKEVYEGEVTELTPVETENPMGGYGKTVSHVIIGLKTAKGTKQLKLDPSIHESLTKEKVEVGDVIYIEANSGAVKRQGRSDTYATEYDLEAEEYVPLPKGDVHKKKEVIQDVTLHDLDVANARPQGGQDVLSIMGQLIKSKKTEITDKLRAEINKVVNRYIDQGIAELVPGVLFIDEVHMLDIETFTYLHQALESAIAPIVVFATNRGRCQVRGAADIISPHGLPLDLLDRLLIIRTAPYSQPEMCQILKLRAVTEGLSIDDDALSELSDIGSKTTLRYAVQLLTPSNLTAKVNGRSTITREDVAEVGQLFLDAKSSAKILAKHQDQYMK

SEQ ID NO: 12493 - protein, 731 aa, Piezodorus guildinii
MTSIIKFHALSGVMDESPPCYILQVDEFRFLLDCGWDEHFNQDYIKELKRHVHLIDAVLLTYPDHLHLGALPYLVGKCGLSCPVYATIPVYKMGQMFMYDLYQSRYNMEDFNVFSLDDVDAAFDKVVQLKYNQSVTMKGKCYGLSIVPMPAGHMIGGTMWKIMKTGEEDIIYAIDFNHKKERHLNGCDLERLQRPSLLITDAFNATYQQERRRARDEKLMTTILQTLSNNGNILIAVDTAGRLLELAHMLDQLWRNKNSGLQIHPLCLINNVSYNVVEFAKSQIEWMSDKLMKSFEAVRNNPFQFKHIRLCHSVSELNKIPSAKVVLASMPDLECGFAREIFFQWASDSKNSIVLTSRCCEGTLARDLLDNGVGRTIQITVKKRVRLEGEELKEYLKAHKKTNDKNEEKESSESEDEIQLLSVTKGSHDLVIKQERRKKNQKSLKKFYPMFPFIDRKVKFDEYGEFVRIEDYKAPDTAKRPPEKKSKKKDDDIVDPADIPTKCVSYEKSLTVNAQVQYIDFEGRSDGESVQKIITQLRPRRVILVRGTSENTEALEKHLQQWSEAKIFCPKKGDIVDATTESHIYQIRLTDSLVSSLHMQKGKDSELAWVDAITKYRQKPSDTMQSAEEMEVEDDGNYSIYNDDYLTLEPLPLTEVNPHQAVFINELKLSDLKQILSRNGIESEFSGGVLWCCNGTIAIRRLESSKVYLEGWISENYYRIREILYGQYAIL

SEQ ID NO: 12494 - protein, 607 aa, Piezodorus guildinii
MPSIDVIQPPPPPPSMEKEETIVQPTTKPIVGIIYPPPEVRNIVDKTASFVARNGPEFESRIRQNELGNPKFNFLNTGDPYHAYYQHKVKEFKEGKGTEPPPPPPPVQQKTVASATQLKQQEILKQVTEQPFVPKDPPPDYEFMADPPSISALDLDIVKLTAQFVARNGRQFLTNLMNREQRNYQFDFLRPQHSLFLYFTKLLEQYTKVLIPPKDLMSRLKEECSNPTGVLEQVRYRADWLHYQELQKRKEEQALEKERVAYAQIDWHDFVVVETVDYIPGEVGNFPPPTTPDEVGARVLMQERILENGGEDLAEGAGSDEEREKEDGEREEGAGDKGDNTQVQDMEEESSSDSDEDDEQREQPPGEKQQAQPGQKQQPPDGKKPPLQPSMQPPLPPAPDKVIVKKGYNPKQNQKISKGADNYLISPLTSEKIPANKVQEHMRIGLLDPRWVEQRDKHIQDRINQETVYAGGSAIEASLKQLAERRTDIFGVGDEETAIGKKIGEEDKKKDDKVTWDGHTSSVEAATRAARANITIEEQIHQIHKVKGLLPDEEKEKIGPKPVPGSVSSSGGTPMPGGPPIVVQAKAPPLPPPPKVPLPPPPAPLPP

SEQ ID NO: 12495 - protein, 313 aa, Piezodorus guildinii
MPGVELVTNKVVVHPLVLLSVVDHFNRMGKIGNQKRVVGVLLGCWKAKGVLDVSNSFAVPFDEDDKDKSVWFLDHDYLENMYGMFKKVNAREKVVGWYHTGPKLHQNDVAINELIRRYCPNSVLVIIDAKPKDLGLPTEAYRAVEEVHDDGSPTTKTFEHVPSEIGAEEAEEVGVEHLLRDIKDTTVGSLSQRVTNQFLGLKGLNQQIQDIRDYLMQVVDGKLPINHQIIYQLQDIFNLLPDMNHGNFVDSLYIKTNDQMLVVYLAALVRAIVALHNLINNKLSNRDAEKKESTKKEEKPKEEENIKKELKAK

SEQ ID NO: 12496 - protein, 541 aa, Piezodorus guildinii
MFQPIFVLSQNSKRESGNKVRSENIAAAKMIAEVIRTCLGPQAMLKMLMDPMGGIVMTNDGNAILREITVQHPAAKMIIEIARTQDEEVGDGTTSVVILCGQIMAEIERHIDEVHPTTIIKEFKRALDDILRILPDISTSLDLKDKAKVIEVVRGCLGTKFLGTWSEMACQMAIDAVETVRDLKGLGIDLKNFAKIEKVPGGFIEDSKVLEGVMLNKDVTHPKMSRYIKNPRILLLDCSLEYKKGESQTNVEIVKEGDYTRLLQIEEEYIEKMCNHIIEHKPNVVITEKGVSDLAQHHLFKAGITAIRRVKKTDNNRIARAVDATIVSRVEEIKPHHIGCGAGLFEVKKIGDEYFTFITECKNPKACTVLLRGPSKDVLNEVQRNLQDAMNVVRNLYLDPRILPGGGAVEMALHRALIKANNAIDLEADCYTAIPSALRIIPRTLLQNAGGKVIRSMNELEKQHNADVLKGVDGITGELKTVDELGVWEPYSVKVQIYKTAIESAILLLKIDDIVSGAKNKDKERNYSSTMAQPTEESLKE

SEQ ID NO: 12497 - protein, 256 aa, Piezodorus guildinii
RKVIFENVGHSWGDLVVNQKLFIKMAMPRTYGGLSDYRSVPAPSFSPYSENGGSVVAVAGDDFAIIASDTRLSTGFQIYTRNQSKLFKLSDKTILGSTGCWCDVLSLTRLVQTRIKMYQYDHNKVMSTPAVAQMLSVLLYYKRFFPYYVANILAGIDDNGKGVVYSYDPIGHHESSKFRAGGTAGALLQPLLDNQLGMLNQENVQDKTYTLEKAHAIVKDVFISAAERDIFTGDRISINILTKDGIREDSFELRKD

SEQ ID NO: 12498 - protein, 299 aa, Piezodorus guildinii
MFGFSMFPFPPRPFKVQYYCFSVAMIPGNEREDVERGGKIIMPPSALDHLTRLNINYPMLFKLHNSKTNRTSHSGVLEFVADEGKVYLPHWMMRNLMLEEGDVIEIESVSLPVATFSRFQPQSPDFLDISNPKAVLENCLRNFACLTTGDIINIKYNQKDYELSVLETQPGTAVTIIECDMNVEFAAPLGYKEPNSEQESLDESSERSENLTNEGSGFIPFFGEGYRLDGKQKKNIEDENVGFRIPAVRGIPDYDWKVGVITFMRNVRQPVKESQKDDEDKFQPFYGEGHVLSTNRHRK

SEQ ID NO: 12499 - protein, 542 aa, Piezodorus guildinii
MAAFPGSIAFDEYGRPFIIIKDQEKQKRLTGNDAIKSHILSAKAIAKIVRTSLGPKGLDKLLVSQDGDVMVSNDGATIMKQMDVDNEIAKLMVQLSQSQDDEIGDGTTGVVVLAGALLEQADILLDKGIHPIRIADGFELAARAAIQHLDSIATKFPVDPNNLEPLIKTAMTTLGSKIVNKCHRQMAEIAVKAVLSVADLETRDVNFELIKVDGKVGGRLEDSMLVKGVVIDKDFSHPQMPKVLKDVKIAILTCPFEPPKPKTKHKLDVTSIDDYRALRKYEEEKFNTMVSQVKDAGATLAICQWGFDDEANHLLLKRELPAVRWVGGPEIELIAIATGGRIVPRFEELSPEKLGRAGLVREISFGTTKDKMLVIEECANSRSVTIFIRGSNQMIIDEAKRSMHDALCVVRNLICDDSIVYGGGAAELSCSIATAKQADKISSIEQYAFRAFSEALESIPFALAENSGLPPMQVVTSVRGRQIQENNPALGVDCMGKGTNDMKEQHVIETLKSKKQQIMLATQLVKMILKIDDVRTPNDIQF

SEQ ID NO: 12500 - protein, 113 aa, Piezodorus guildinii; identical to SEQ ID NO: 12274

SEQ ID NO: 12501 - protein, 534 aa, Piezodorus guildinii
MVSLNPIRILKHEAEEEKGEMARMSNFIGAIAVGDLVKSTLGPKGMDKILVSYGRNRGNIEVTNDGATILKSVGFDNPAAKILVNMSKVQDDEVGDGTTSVTVLAAELLREAERLIERKIHPQTIISGYRKATNVALAALDKCAVDNSSNDKEFADDLLKIARTSLSSKILNLHTEKFSKLAVEAVLRLKGSGNLSAIQIIKKTGGSLDDSFLDDGFLLDKKVGQFQPKRVENARILIANTPLDTDKIKVFGSRIRVDSLAKVADLELAEKEKMKEKIERIISHKCNVFVNRQLIYNYPEQLFADAGIMAIEHADFDGIERLALVTGGEIVSTFDTPELVKLGECDLIEEVMIGEDKLLRFSGVKLGEACSIVIRGATQQIVDEAERSLHDALCVLVTTVRDKKTVFGGGCSEIIMASAVSDEAINVTGKEAVAMESFAKALLELPMTISDNGGFDSAYLVTALRAAHNKGQITYGLDMKNGGVACMRELGIVESHSVKRQMLLSASEATEVILRVDDILKAAPRKRTEDRGYC

SEQ ID NO: 12502 - protein, 277 aa, Piezodorus guildinii
MFRNQYDSDVTVWSPQGRLHQVEYAMEAVKLGAATVGVKNKQYAVLVALKRASSELSAHQKKIIPLDNHIGMSISGLTADARILSRQMRSECLSYSYSYGTEIPIIRLMNKISNMMQSSTQRYDRRPYGVGLLVAGYDADGPHIFQICPSANLYECRSMAIGARSQSARTYLEKHLVDIGNSPTLTDLLKHALRALRDSSPNDTELSSKNVAIAVVGKDTPLKELSEADTQTYLDMILSEERRSGDTAGGTDDAPPPPPPSDPPAQDPTPVVAMETQ

SEQ ID NO: 12503 - protein, 846 aa, Piezodorus guildinii
MPVYQERKPKIVINEEDLPYEEEILRNPFSIKHWLRYIEFKKDAPRNGVNIIYERALKELPGSYKLWYNYLILRKRQIKGRCITDPSFEHLNNTYERSLVFMNKMPRIWMEYCQFLVDQCKITKARHVFDRSLRALPITQHHRIWPLYIKFLKKHNIPETAVRVFRRYLKLCPEDTEEYIDYLTTIGRLDEAAVRLADIVNTDDFVSKHGKSNHQLWTELCDLISKNPQEVRSLNVDAIIRSGLKKYTDQLGHLWNSLADYYIRSGLFEKARDIYEEAIQTVTTVRDFTQVFDAYAQFEELSLSKKMEEVSHKAFPTDDDDIDIELRLARFEDLIERRLLLLNSVLLRQNPHNVHEWLKRVQLFEGKPHDIIYTYTEAVQTVDPKLAVGKPHMLYVNFAKFYEENGQVEDSRIVLEKGTQVPYTKVEDLASVWCEWAEMEIRNENCDEALKILQRATVMPARKVDYHDDSETVQMRLYKSLKIWSLYADLEESFGTFKSCKSVYDRIIDLKIATPQIIINYGLFLEEHNYFEEAFRTYEKGIALFKWPNVFDVWNTYLTKFLKRYGGSKLERTRDLFEQCLENCPPKYAKGFYLLYAKLEEEHGLARHAMAVYERATSAVLPEEMFEVFNIYIKKAAEIYGVPKTRQIYEKAIEVLGEDNSREMCLRFAEMETKLGEIDRARAIYAHCSQMCDPRVTSTFWQTWKDFEVRHGNEDTMREMLRIKRSVQATYNTQVNMMSAQMLSAASNVSGTVADLAPGAKDGMRMLEAKAAEMTVTPKSGASAIMFVRGETQNTPQDVQKEIHNPEALNIDSDDEENMEDDDLPVEKQIIPDEVFCGLKKGSDSD

SEQ ID NO: 12504 - protein, 329 aa, Piezodorus guildinii
MAAGPIAERNQDATIYVGGLDDKVSETLMWELFVQAGPVVNVHMPKDRVTQQHQGYGFVEFLGEEDADYAIKIMNMIKVHGKPIRVNKASAHQKNLDVGANVFIGNLDPEVDEKLLYDTFSAFGVILQTPKIMRDPDTGNSKGFAFINYASFDASDAAIDAMNGQFLCNRPVSVSYAYKKDAKGERHGSAAERLLAAQNPLSQADRPHHMFADAPPAPLPPPPVLPPPPVFNPPPPPHMPPPPLPPQRMVAPMPPPPPGPPPPMPPGMMPWPPMQPHFPPPPPPPPTNKAPPLPPPPPPQAWRPPPPPYNRPPFPPPPPPPVRPPPPMF

SEQ ID NO: 12505 - protein, 258 aa, Piezodorus guildinii
MGRVIRAQRKGAGSVFRSHTKHRKGAPKLRSLDFAERHGYIKGVVKDIIHDPGRGAPLAVVHFRDPYRFKTRKELFIAPEGIYTGQFLYCGKKANLHVGNVMPVGTMPEGTIICNLEEKTGDRGRLARASGNYAIVIAHNPDSRRTRVKLPSGAKKVIPSNNRAMVGIVAGGGRIDKPVLKAGRAYYKYKAKRNCWPKVRGVAMNPVEHPHGGGNHQHIGKASTVKRGTSAGRKVGLIAARRTGRIRGGKTDQKKGED

SEQ ID NO: 12506 - protein, 136 aa, Piezodorus guildinii [sequence omitted]

SEQ ID NO: 12507 - protein, 531 aa, Piezodorus guildinii
MAAITLLNPKAEVVRKTEALSMNQSAAKGLQDVMKTNLGPRGTMKMLVSGAGDIKITKDGNVLLKEMQIQHPTASLIARTSTAMDDITGDGTTSTVLLIAELLKKADNYIIEGVHPRLITEGFTVACKHAMEVLDSIKKPVSLDDKETLISVARTALNTKVESKVAEVLTHICVEAVQAIKLPDKPLDLHMVEIMTMQSRLESETRLVRGLVLDHGSRHPNMPKKLTNAYILTCNVSLEFEKTEINSGFFYKSAEEREKLVASEREFIELRVKKIIALKKSVCDGTDKGFVVINQKGIDPVSLDMLAREGIMALRRAKRRNMERLTLACGGVAMNSLDDLTEDCLGRAGLVYEHVLGETKYTFVSDCPNPHSVTVLVHGPTSYAITQIQDALRDGLRAVKNAVEDGGILPGGGAVELKLRHELKKVAENTKEKYRVGIEAFCDALLIIPKTLAMNSGFNTQEVITQLDYDAKDNDVIGLDLQTGKSMVPTDLGILDNYSVKKQYIASSVIVASNLLLVDEVMRAGMSSLKG

SEQ ID NO: 12508 - protein, 1047 aa, Piezodorus guildinii
MSSAEVANNSIEPPAKKRKIATGETAPANSVSKAISAMANNGSFDSNQEIDEGLYSRQLYVLGHDAMRRMASSDVLISGLGGLGVEIAKNVILGGVKSVTLHDETVCTISDLSSQFYLSENSIGLNRAEASCQLLAELNNYVPTRAYTGTLTEDFIKGFSVVVLTNASEEEKLRISEIAHASDVSLIIASTRGVFAQVFCDFGREFSVVDTNGENPVSAMIASISRDEEGVIACLDDTRHGLEDGDYVTFSEIQGMTELNGCEPTKIKVLGPYTFSIGNTSNYAEYIRGGIVQQVKMPKVLQFKSYSEALKSPEFIFTDFGKFDHPQQLHVAFKALENYKKEFGKLPTPWDNKDAADFVNCCKSVVSDLGLDVELNEKLMQQFAKTCSGNMNPIDAFIGGVVAQEVMKACSGKFHPIFQWLYFDSIELLPTEDLNPSECAPTNSRYDGQVAIFGTEFQKMLGALKYFVVGAGAIGCELLKNFSMMGVGADGGKVIVTDMDLIEKSNLNRQFLFRPHDVQKPKSATAAKAIKKMNPLMNVIAHENRVGPETEKVYDDAFFEDLDGVANALDNVDARIYMDRRCVYYRKPLLESGTLGTKGNTQVVVPFLTESYSSSQDPPEKSIPICTLKNFPNAIEHTLQWARDVFEGLFRQSAENAALYLSDPNFIDRTLRLPGVQPMEVLESIKQALIDDRPKSIEDCIAWARNHWQEQYSNQIRQLLFNFPPDQMTTNGQPFWSGPKRCPVPLEFDVNNDLHLDYILAAANLKAEVYGIPQVRDRNFIAKVVQNVEVPEFTPKSGVKIAVTDSQMANGAGGQVDQDRIGQLQNELPSKEMFNGLNITPLEFEKDDDNNLHMDFIVAASNLRAANYNIPPADRHKSKLIAGKIIPAIATTTSVVAGLVCIELMKLAKGYKDIALFKNGFVNLALPFFGFSEPISAPKLKYYENEWTLWDRFEVTGEMTLKEFIDYFKDKHQLEITMLSQGVCMLYSFFMAKSKLEDRLNLPMSEVVRRVSKRKLEPHVKALVFELCCNDTDGNDVEVPYVRYTLP

SEQ ID NO: 12509 - protein, 425 aa, Piezodorus guildinii
MADNDDLLDYEDEEQTEQPIVEGSGDTAPRKDLKGAYVSIHSSGFRDFLLKPEILRAIVDCGFEHPSEVQHECIPQAVLGMDILCQAKSGMGKTAVFVLATLQQMELTENQVTVLVMCHTRELAFQISKEYERFSKYMPNIKVAVFFGGLPIQKDEEVLKNNCPHIVVGTPGRILALVKNKKLNLKNLKHFVLDECDKMLEQLDMRRDVQEIFRNTPHSKQVMMFSATLSKDIRPVCKKFMQDPMEVYVDDEAKLTLHGLQQHYVKLKENEKNKKLFDLLDILEFNQVVIFVKSVQRCMALAQLLCDQNFPAVAIHRAMSQEERLAKYQEFKDFQKRILVATNLFGRGMDIERVNIVFNYDMPEDSDTYLHRVARAGRFGTKGLAITFASDEADAKVLNNVQDRFDVNITELPEEIDLSSYIDGR

SEQ ID NO: 12510 - protein, 487 aa, Piezodorus guildinii
MPVEAMQTDVEMKVVDSPSSEDPVASAVQEIREHIRQLEKAVANKEPRFILRVLRLLPSTRHKLSAAVLRNVISSFYLSSPEKDALFLYIEDADDSDTTQKTKLIKNSNVPLLPEIDAYIHLLVLVRLIDAGKESEAVKCSDALMAKITAQNRRSLDLVAAKCYFYHSRVYELTNQLEKIRGFLHARLRTATLRNDFEGQAVLINCLLRNYLHYKLYDQADKLVSKSVYPESASNNEWARFLYYLGRIKAARLEYSESHKHLVQALRKAPQHAAVGFRQTVQKLAVTVDLLLGDIPDRQIFRQAPLRRSLAPYLQLTQAVRTGDLQRFGEVLEMFGPQFRSDHTFTLILRLRHNVIKTAIRCIGLSYSRITPTNIASKLGLDSPEDAEFIVAKAIRDGVIEATLDPEHGYMQSNEVTDIYRTREPQLAYHQRISFCLDLHNQSVKAMRYPPKSYGKDLESAEERREREQQDLELAKEMAEEDDDVFP

SEQ ID NO: 12511 - protein, 586 aa, Piezodorus guildinii
MALSTPSVPVSEILKSSADSDEPKKKSREDWRKAKELEEARKAGTAPAAVDEEGKDINPHIPQYISSAPWYYSARGPTLKHQRIQDESVKKFSGIDEWYKRGVDTTKVVTKYRKGACENCGALTHQKKDCMERPRKIGAKFTGAKIAPDEFVQPELSRDYDGKRDRWAGYDPSQHKMVIERYARIDEAKRQLRAEKLNSEQTEEAEEEETKDSAADEGGEDEDKYVDEVDMPGTKVDSKQRITVRNLRIREDTAKYLRNLDPNSAYYDPKTRSMRDNPYAGSADADVDYAGENFVRFTGDTLEHAKVQLFAWEAHNKGVDVHPLGEPTRLEVLKKEFVGIKEEFKQKGQEDLIKKYGGEEHLKAPPKELLLAQTEYYAEYTRYGTVIKGQEKEVVRSRYEEDVFINNHTTVWGSFWHSGKWGYKCCHSFIKGSYCTGEAGRLATAGEVAVKGPAFIPPRPATPTASSSSSSSSDSSSSSSSSSEDEEEKERKKKKQEKKKAKKKKQKVKKLKNKNKKPEEKTEEEQLKEALKKEEEAQREGDRLAKMDDRKRPYNSMFEVQKPTDVEMEAYYMKKKRDEDPMANFL

SEQ ID NO: 12512 - protein, 208 aa, Piezodorus guildinii
MGISRDHYHKRRKTGGKRKPIRKKRKYELGRPAANTKLGPKRVHLVRTRGGNTKFRALRLDYGNFSWGSECCTRKTRLIDVVYNASNNELVRTKTLVKNAIVVIDATPFRQWYEAHYALPLGRKKNAKLSEAEEAVLYKKRSRKTENRYKARQKLAKVEPALEEQFQTGRLLACLASRPGQCGRADGYILEGKELEFYLRKIKAKKGK

SEQ ID NO: 12513 - protein, 311 aa, Piezodorus guildinii; identical to SEQ ID NO: 12287

SEQ ID NO: 12514 - protein, 405 aa, Piezodorus guildinii; identical to SEQ ID NO: 12288

SEQ ID NO: 12515 - protein, 200 aa, Piezodorus guildinii
MVKLYALHILYKNLNSAVWLKTAYDVQSFGYFQRGTAQDTMAFASKTIVERTQSATRQSVKEGDYICHVYVRADNLAGVVISNHEYPHRVAHTLITKVLDEFSAKYPPSTWASANESNIDFPALAAHLQKFQNPKEADALMKIQSELDETKIILHNTIGAVLERGEKLDDLIMKSESLSYQSKAFYKTARKTNSCCSYVG

SEQ ID NO: 12516 - protein, 249 aa, Piezodorus guildinii
MFLTRSEYDRGVNTFSPEGRLFQVEYAIEAIKLGSTAIGVCTPEGVVMGAEKRIKSPLMEPEAVEKILQVDDHIGCAVSGLMADSRTLVEHARVQCLNHWFVYDEKMPIESAAQAVSNLAIRFGDADEDAGPAMSRPFGVAVMFGGYDYRGPQLYHMDPSGTFIYFDAKAIGSGSEGAQQRLQELYHKGMSLKEAMQMILTILKEVMEEKLTDNNVEIAVVTAEEKQFRMYTKEEVSKVIGETQSAQTS

SEQ ID NO: 12517 - protein, 388 aa, Piezodorus guildinii
MSEYWLISAPGDKTCQQTWETMNNLTSKQHNLSENFKFHIPDLKVGTLDQLVGLSDDLGKLDNFVDQVTHKVAQYLGEVLEDQKDKLQENLMANNTDLSTYITKFQWDMAKYPIKQSLRNIADIISKQVNQIDADLKTKSTAYNNLKSSLQNMEKKQSASLLTRNLADLVKKEHFILDSEYLTTLLVVVPKSNFNDWNSSYEKLTNMIVPRSSQLVYQDSDFGLFTVSLFKKVVNDFKLMAREKKFVVRDFIYNEEELAAGKNEITKLVTDKKKQFGPLVRWLKVNFSECFCAWIHVKALRVFVESVLRYGLPVNFQAMLIHPHKKSVKRLRDLLNQLYAPLDSSAQQQGNQGGGNDSVDIPGLGFGQSDYYPYVYYKINIDMLDTKA

SEQ ID NO: 12518 - protein, 548 aa, Piezodorus guildinii
MSTLGVPLSVGGTRTSGAPVRTQNVMAACSIANIVKSSLGPLGLDKMLVDDIGDVTVTNDGATILRLLEVDHPAARVLVDLAQLQDEEIGDGTTSVVIIAAELLRNADELVKQNIHPTSIISGYRLACKEAQKYIQEHLCVSVDELGKDSIINIAKTSLSSKVIGIDDDFFASMVVEAAQAVKVNDSKGKASYPIKAINILKAHGGSAKESILVNGYALNCTVASMGMTKRVENAKIACLDFSLQKTKMKLGVEVLVEDPNQLEAIRDREADITKDRIQKILSVGTNVVLLSGGIDDIYMKYFVEANAMVVRRVKKSDLKRIAKATGASFATSLTNMEGEEAFDASLLGEAAEVSQERICDDELILVKGPKAHSAASIILRGPNDYFCDEMERSIHDSLCAVKRVLESKTVVAGGGAVEAALSIYLENFATSLSSREQLAIAEYAKSLLVIPKILAVNAALDSTDLVAKLRAYHNTSQTKKDHAHLKWHGLDLYGGAVRDNKKAGVLEPTISKIKSLKFATEAAITILRIDDLIRLEAEKKDQGHGDM

SEQ ID NO: 12519 - protein, 261 aa, Piezodorus guildinii
MLSLADASTNFDHNSIRSNDRHGNTLDDNQVKIIKAPDFLTRTLYPMTTTASVVGIKFNNGVAIAADVGGYYGSLNRFKSLDRLYKVNNNIVMTTTGDYADFQYIRELIQQKVISEEILDDSFSLKAFSLHTWLTRLMYNRRSKFDPLWNNVIVAGFDSNGPFLGIVDKLGMSYEDSCVATGMGGYLATPLLRDVYERGKGNLTKQEAHAALQKCMEILYYRDTQSLPKFQIATVTEEGVEISPELEVEGNWEIVKHSKGF

SEQ ID NO: 12520 - protein, 684 aa, Piezodorus guildinii
MNDHLKKFSGVDFNPDKYVKEISQVCVGGIELQSHRAKIQALAEETSQNLKKNVYKNYMQFIETAREISHLEGEMYQLSHLLSEQRALLGSMSNSGSEPVLQAGGSKAQEEKRIAALSSISEVIESCPDLLDTPGREILHEGDLVELDPLENTALHRTRALLFSDMFMIATWMSERKGQAKYKFESSYDLGSMAVVNVRDLGQVKHAFKLLVFPDTRLFQCVNNEAREEWLKKFDEAKKARLNSEQTKKKGENDKESYTIREQSTKPPERTDSVEFGSNPFGFVLDDDADSDALPEWLTEAADDFDVSIAQRHFEEAYAIIQKTEEYFASAQDDQGLADIKSKLENRKDVLICVLLSELNVSAEKSLQGGLRASRRAVRLLNQLNKSTQACELYLKVCTNLLKAQSKRVKREGATVAYVKRLSEVYFSNLASITSEFQYRAFPHNQDCTSAFVVWVSMEVSNFLSHIIKQVFIPQTPLGTLAECIDIIRKQSQQMCELGLDLSYQVNGQTMAAVTRAVAEAGEKAVDAVKVRAAEDPWRPSRQTQQSINKIQSELGLPVSEYLVDYGVFELTANSLSFAKLLSSLTDEGLMISCQDLEHALSKALNEVLKAHLNHLSASYSSNKFRSQRSLIQQNAKFILDQLLEAVQRKYSEKMGHRCKKLDILRKEYNFILKESKTTVTGYI

SEQ ID NO: 12521 - protein, 1263 aa, Piezodorus guildinii
MDEVKKLEHLSLVSKICTELENHLGLNDKDLAEFIIDLASKNNTFESFKKALLDNDAEFSDSFISNLLRIIQHMRPKNEVTVTKDMTKQDKLSMKFPGLAIPNEVQQTKNHSEKKFNLSTIKEDPEDNEVEDAMAALEALAPSKEMKFALKTERASRSPEKVIKQESDKIRKRSRSRSRNRDKKRNRSRSRSRGRGRSKEKSSGKSRQRSTSRGRRRRSRDRSSSRNRGQVKNWDRERERERRVKNDRRSRSRSNGRRRNERSRSRSTGRRRNDRSRSRSYDRKKNDKKRENEDEKNKTDEPLEPEVGKIYNGKVTNIVSFGCFVQIEGLKRRWEGLVHISQLRREGRVTSASDVVSRGMKVMIKVLSVAGQKVSLSMKDVDQETGKDLNPTVRHAINKDREEEASMRNPDRPTTLLDLGSFDDHDDFQSRKRVNRISSPEKWEIKQMLSASCIDKSELPDFDEETGLLPKEAAEEEDIEIEIVEEEPPFLQGHGRNLHDLSPVRIVKNPDGSLAQAAMMQSALAKERREQKMLNREQEMDQMPTGLNKNWIDPLPESDGRTLAANMRGIGLTNQDLPEWKKHVIGGKKSSFGMKTNMTLLEQRQSLPIYKLKEQLIKAVTENQILIVIGETGSGKTTQMTQYLAEAGFTSRGKIGCTQPRRVAAMSVAKRVAEEFGCRLGQEVGYTIRFEDCTSPETVIKYMTDGMLLRECLVDLDLKSYSVIMLDEAHERTIHTDVLFGLLKQAVQKRSELKLIVTSATLDAVKFSQYFFEAPIFTIPGRTFPVEVLYTKEPETDYLDASLITVMQIHLREPPGDILLFLTGQEEIDTACEILYERMKSLGPDVPELIILPVYSALPSEMQTRIFEAAPPGSRKVVIATNIAETSLTIHGIFYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAPPVESLIMALEQLHSLSALDDEGLLTRLGRRMAEFPLEPNLSKMLIMSVHLQCSDEILTVVSMLSVQNVFYRPKDKQALADQKKAKFNQAEGDHLTLLAVYNSWKNNKFSNAWCYENFVQIRTLKRAQDVRKQLLGIMDRHKLDVVSAGKNTVRVQKAVCSGFFRNAAKKDPQEGYRTLVDSQVVYIHPSSALFNRQPEWVIYHELVQTTKEYMREVTTIDPKWLVEFAPAFFKFSDPTKLSKFKKNQRLEPLYNKYEEPNAWRISRVRRRRN

SEQ ID NO: 12522 - protein, 414 aa, Piezodorus guildinii
MAPTRKTEGLLARVNFPLYTLQMLTSRHVLVGGGGGSAKTGVANGFEIFELSYDGTRFSAEEVIRHETGSKVVMNSACYSDKKSTFLVAGQESHCQLYRVGITVEKEVSEEPMNGILEPPNLRHRKPSRNHQNGISEVKNIVKKKLVFKFNSGDSIQSDFSENEPCQRVVTISRCGGWMATGGTDGIVRIWSFPSLRLIRALKAHTKELDDLHFSPDSKQIASVAKDGQAIIWELKSGKQVHKLDWTHPAGIKYLFKRCRFGIVEGKGCRLFTTVNPVAGGKDAQGWIHAWDDGRIFKSAAVSEPTSALAVRDDGIFIAIGTMFTGSVSIYIAFSLQRVLHVDGAHSMFVTGVELLPCSSSWGAIEAAALSISVDNRVCIHSLPFRRTLPPWLVIIIIMLTLLFTFVLCSFIGL

SEQ ID NO: 12523 - protein, 417 aa, Piezodorus guildinii
MAGAMLFERTVSSRDRDNSRILPTSSRNVDDDNDEEDIRNKEQGILQLGEQYKKEGKAKELAELIKASRPFLSQISKAKAAKLVRSLVDYFLDLEAGIGIEVQLCKECIEWAKDEHRTFLRQSLEARLIALYFDTGMFTEALQLGSSLLKELKKLDDKNLLVEVLLLESKTYHALSNLSKARAALTSARTTANSIYCPPKMQAALDLQSGILHAADEQDFKTAYSYFYEAFEGYDSVDSPKALVALKYMLLSKIMLNTPEDVQQLVSGKLALKHAGKDIDAMKSVAQASHKRSLADFQITLKNYKKELEEDPIVRAHLGTLYDNMLEQNLCRIIEPYSRVQVDFISKSIKLPLPQVEKKLSQMILDKKFNGILDQGEGVLIVFEDAVVEKTYEMALEVINSMGKVVDTLYQKAKKLS

SEQ ID NO: 12524 - protein, 599 aa, Piezodorus guildinii
MSTKSPKKTTPAGSSSAGPSRSSPRKSETPTPQGARKSPLSPTRYSRLHEKQELANLNDRLACYIDRVRNLETENNRLTREVKSSQENITREVTSVKSLYESELSEARKLLDELSREKTKLQIDTRRLYTENEELKTELEKKTKDCNILQTSLSVSENRLADLTTKYNQLQGERKKLADENKALENERNKLAVQLSDTRKHLEEETLQRVDLENAVQTLREDFSFKEQLHEQQLLETRTKKQVEISELDGRLSQEYEERLYQSLQEIRDQYECDLENNKEEIKKLYEEKIRSLGSQLTRNSNAAAMAIEEMKNMQAKLNELNRKLLDLEADRNAAQQKARDLEKILEQAKAQYMEEYSQREAEITTLREEMAHQVQEYQDLMDIKVALDLEIAAYRKLLEGEEARLNITPVSSPAQTSSRKVLGRKRKRTFIEESDETDLSNYSVTSSSKCDVAISEVCSEGQFIKLLNKSNKEVSLGGWQLTRKAGESSTIYKFHRTIKMEPGATITIWSSDVPDKSHEPPENLLMKGQRWMVADTMTTVLSNPAGEEMAISEHKKQQLSDRTSSRQREGSFYQKRTFLSSSMRPPSETPGEERCVIW

SEQ ID NO: 12525 - protein, 802 aa, Piezodorus guildinii
MADMKSNEDLSTAILKKKDRPNRLIVEDAVNDDNSVVALSQAKMDELQLFRGDTVQLKGKRRKETVCIVLSDDTCPDEKIRMNRVVRNNLRVRLSDIVSIQACPEVKYGKRIHVLPIDDTVEGLTGNLFEVFLKPYFLEAYRPIHKDDTFVVRGGMRAVEFKVVETDPAPYCIVAPDTIIHCEGNHIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEQAEKHAPSIIFIDELDAIAPKRDKTHGEVERRIVSQLLTLMDGLKQNSHIIVMAATNRPNSIDAALRRFGRFDREIDIGIPDTTGRLEVLRIHTKNMKLADDVNLEQIAAETHGHVGADLASLCSEAALQQIREKMDLIDLEEEQIDAEVLNSLAVTMDNFRYAMGKSSPSALRETVVEVPNITWDDIGGLDNVKKELQELVQYPVEHPEKFLKFGMQPSRGVLFYGPPGCGKTLLAKAIANECQANFISVKGPELLTMWFGESEANVRDIFDKARAAAPCVLFFDELDSIAKSRGGSVGDAGGAADRVINQILTEMDGMGAKKNVFIIGATNRPDIIDPAILRPGRLDQLIYIPLPDEKSREAIFRANLRKSPVAKDVDLQYIAKVTFGYSGADLTEVCQRACKLAIRQSIEAEIKREKSRLDGATRMDMDDEDPVPEITREHFEEAMRFARRSVTDNDIRKYEMFAQTLQQSRGFGTNFRFPASSNIPSAPGGGGTETNNFPDDGDDDLYN

SEQ ID NO: 12526 - protein, 277 aa, Piezodorus guildinii
MTDQQMDCALDLMRRLPPQEIEKNLSDLIDLVPSLCEELLSSVDQPLKIAIDKGVGKDYLLCDYNRDGDSYRSPWSNTYDPPLEDGSMPSERLRKLEVEANAAFDQYREMYFEGGVSSVYLWDLDMTGFAGAILIKKAGDGSKKIKGCWDSIHVVEVQEKTTGRNAHYKLTSTVMLWLQTNKTGSGTMNLGGSLTRQMEQDAAVSDASPHIANIGRMVEDMENKIRNILNDIYFGKTKDIVNGLRSTQALSEQKAQAALRQDLAVALQKRQAKTADN

SEQ ID NO: 12527 - protein, 1238 aa, Piezodorus guildinii
MQQMDSLQPNNATGLVKSGLEAGAGSGMKEPPPREEPVLDPINGVVQPPVIPPPHRPGRVTNQLQYIQKNVLKAVWKHQYAWPLQQPVDANKLNLPDYHKVIKHPMDLGTIKKRLENNYYWCGAECIQDFNTMFNNCYVYNKPGEDVVVMAQTLEKIYLQKLETMPKEEIELEPPPPKGSKPVKKRPGVIGPGRGGGTTGAGRGRPSNSTTAATAAVVATPVPPVTPPSHLPPTIPGSTATTTVATTHHNSLPPQVGQPAAVPSNFNATPVDPLLTPGLAPGVGPKGGKGAVVQTPTAPKPKKGVKRKADQNDSPAGFDPTYTPGDSKAAKVGTRRESGRQIKKPQRQSDDGMPFSQSPMAPYAHSNSNQASHEKPKEKLSETLKACNEILKELFSKKHFNYAWPFYKPVDAEWLGLHDYHDIIKKPMDLGTVKQKMDNREYKTATEFAADVRLIFTNCYKYNPPDHDVVAMGRKLQDVFEVRFAQVPEESPAVAPPPPEKEEESSSGSSSGSESETDDSDDERARKLSQLQEQLRMMQEEMTKLLEKGALKKKKKKKDGSGSGGSSSSKKRKSADRTLGKTADGSMLAGAGAPAVAEMKAADGVKAAPPPGRNAVPSPQVKPNKGKAPGRTPGKTNSQGKRPKPNSRSTNSKKKNPVVTSEFNSEDEDNAKPMSYDEKRQLSLDINKLPGDKLGRVVHIIQAREPSLRDSNPDEIEIDFETLKPSTLRELESYVASCLRKKPHKKVSAKSKDEAMAEKKQELEKRLQDVTGQLGGSAKKQAKKQGQGRLSASSSSSSDSDSSSSSLSSSSSDSSDSEAGKAGRPAKKKNKKNHLLATTTASTVQQNQTVPSLTMTTATGTIVNKTVGASQPIVPLASTNKPTVPPVSSVAQPEPVKPVVVASHILPPQPARPTATAAPLTTAKRASIPTPGTTLGIPPTAPTALETGPIEIKQELDVPVSLAPVPDHLDFKNLLEVKPELNDIVTGMPSVFDPLPDSPPIIKEEKLPILPHHTDGHLNNSLPPVSNVPGPPVIPSAALPTTPHILDMNKNSQPPQLPQTPVMQHNFKPKSVEQNLKNASSWSSLAQSPTPALTPTPPTAAALKSSMADSFQAFKKQAKENAKKQRALIEQQEMRRHQKEQAERERLRVETEKRREREEEEALEKARKAAVVASGGRVEEVKNAAIEEGSSPGSADKAAAERERLRQREQERRRREAMAGQIDMNRQSDLMAAFEQTL

SEQ ID NO: 12528 - protein, 430 aa, Piezodorus guildinii
MIPPSSRPQVTVYSDKNEPTGELLTLPAVFNAPIRPDVVNFVHQNIAKNHRQPYAVSAEAGHQTSAESWGTGRAVARIPRVRGGGTHRSGQGAFGNMCRGGRMFAPTRVWRRWHRKVNVNQKRYAMVSAIAATGVPALVMSKGHMVNEVPEIPLVVTDKIQEYTKTKQATIFLHRIKAWSDIQKVYKSKRFRAGKGKMRNRRRIQRRGPLIIYGQDQGLTRAFRNIPGVDLINVSRLNLLKLAPGGHVGRFVIWTQSAFDQLNALYGTWKKKSTLKKDYNLPMPKMVNTDLSRLFKSEEIKSVLKAPRKTIVRRVRKLNPLRNTRAMLKLNPFAAVLKRKAILADRKLKLERAIERSKKEGIELTPHQKRYVAMLERRKAQIKAAKAAKPKKVKKPKAEKTEAAEAKKASVTKKPAKKATTAAAPKPAKK

SEQ ID NO: 12529 - protein, 1819 aa, Piezodorus guildinii
MADFIDSEAEESEDEEELEVHEKKKLKRLKAMESDEDEEEEDDEERLREELKDLIDDNPIEEESESDDGSGSEEGSGEDRGGEKRKKHDEDFDDRLEDEDYDLLEENLGRKVERRKRFKRLRRIEDEESDGEGAEDEGEVREAIANELFEGSDHEEDRSSSRGPAAPERYEDEEEDGEYSDADDFIVDDEGRPIADKRKKRKPIFTDAALQEAQDIFGVDFDYEDFERLGEDEYEEEEDEDEYVDEEGIEDSERRRKPTKKAARKKPTRKSIFEIYEPSELKRGHFTDFDNKVRNTDIPERMQLREIPVTPVPEGSDELSEEAEWIYKQAFCKPTTSNQEWGNTMERGKPKKEPQTVEKIKKALDFMRNQNFEVPFIAFYRKEYVLPELNINDLWRVFKYDAKWCQLRSRKMTLLSLMEKMRDYQAEQLMKDIDAPIPDHVRVIKDDDIERLKAVQTTEELKDVHSHFLMYYADEVKIMLEATRVKEREAAKAKARQEKQVDENGDPIETEVEEQEEPPPPEIPAVKHSIRSGPYAICRKAGIGGLAKRFGLKPEQFAENLRDNYQRHDVEQEPSLPIELAKEFVSSKFQSPEDVLKAAKFMVATQLSREPLVRRCMRDTFFEKAKIDVKPTKKGSKEVDENHPCYVMKYMKGKPVRDLTADQYLKLHIAHQDKLLNVSISDHIGGHTTTSYIEEIKQLYYRDEFMQHVQEWNNIRQECVDVAIKKMLIPELIKELHTRLLEEAKEFVLRSCARKVYNWIKVAPFSVEFGDDDEDDWDTSKGIRVMGVAYVPDLAQASFACMVAPDGECTDFLRLPHLLKRKNTWREDERMQKESDLALIRNFILTKKPHAVVIGGESRDALMVAADLREIISNLVEDEQFPQIPVEIMDNDLAKVYANSLKGESDFRDYPMLLRQAVSLARRLQDPLVEFSQLCTPDDEILCLRFHPLQEQLSKEELLDVVTLEFVNRTNEVGVDINEVVANPICGNLVQFVCGLGPRKGTTLIKILKQTNQRLENRTQLVTTCHMGPKVFINCAGFIKIDTNALGDSTEAYVEVLDGSRVHPETYEWARKMAVDALEYDDEDANPAGALEEILEKPEKLKDLDLDAFAEELERQSFGNKSITLYDIRSELNHRYKDLRVPYQSPGPELMFDMLTKETPETFYIGKLVTATVIGISHRKPEKDQLDQANPVRNDETGLWQCPFCLKNDFPELSEVWNHFDAGGCPGQATGVRIRLDNGITGYIHIKNLSDKHVTDPAQRVTRGQMIHCRVTKIEVERFSIEATSKSSDLLDKNHDWRPQKDPYYDHESEKKDLHTEEEAKKNRQKLTYIKRVIVHPAFHNISYIEAEKIMATMEQGDVIVRPSSKGADHLTVTWKVADGIYQHIDVREEGKENAFSLGQSLWIGNEEFEDLDEIIARHVNPMAAYVRDMFAFKYLKDTEGGLKDKAEEFLKEEKKKNPAKIHYIVSVSKNYPGKFLLSYLPRARCKHEYISITPNGFKFRGQFFESVNSLFKWFKEHFSDPIPGTPSTPRSAMSARTPYTNTPGPMPINMNAEAIQRVAQNMPNHMLHSLSQVASHTPHYPHTPGAYSLHQYPATPYTPSGQTPFMTPYTTPRYGSGMTPGHQSIMSSGSITSPQSSTPGQPVFLHPGSITPSHRTPVANFHRPGGTHPEDWGKKAEEWVAKKRENASRTPRSTPNTGTPRHGTPRDDANKNRTPRYADNDYTSPRPGANFTSPRYSNWNKVAGTPNSHISAYEDANYDARSLKSPRPPPAQGKYDPYELGQGKSPRYSMTPRSTPRTINSPRSMSLGDSTPLYDESI

SEQ ID NO: 12530 - protein, 767 aa, Piezodorus guildinii
MEESKERSKSCRKHGRSSEKTEHKSKSDKDYSERESKRRRNHDYDKYDKHSSRDRRRDSDRRNYEKYERYWGKDKEEDHHDRDVKADYLVGSRYYKETPKHEPQVRKSEGANKSKENVNPLESAGKEKPVTRKKNDDIITSRTGGAYIPPGKLRLMQASITDKSSAEYQRIAWEALKKSIHGHINKVNTSNIGVVARLLFKENIIRGRGLLCRSIIQAQSASITFTNVYACLVAIVNSKFPSIGELLLKRVIIRFKRAYKRNDKAVCISSATFIAHLINQGVAHEILGLELVTLLVENPTDDSIEVAVAFLKEAGQKLSEVTSKGTNAIFDMLRNILHEGKLEKRVQYMIEVMFQVRKDDFATFPSVPEELDLVDEEDQFTHLIGLDDAIDTQDILNVFKLDSEYQANEERYKELRSEILDTDSEESGSEGDSSGEGEDDDSDEEDEEKKVTIVDNTETNLISLRKTIYLTIQSSLDFEECAHKLLKMEIKPGQEKELCHMFLDCCAEQRTYEKFFGLLAQRFCQVNNTYIAPFEQIFADTYSTVHRLDTNRLRNVAKLFAHLLFTDAISWAVLSNIRLNEEDTTSSSRIFIKILFQELSEYMGLANLNARLKDPTLQSAMEGLFPRDNPKNTRFAINFFTSIGLGGLTDELREHLKNLPKSIPVAQLIQELSSESSSSSESSSSSSSSESESSSSSDSSEEERRKTAKRKKRPNVSKEDSNKKKERKRGNSQENHRSTKETKNKTPEKKRKHQREEKHHSRKSKRK

SEQ ID NO: 12531 - protein, 585 aa, Piezodorus guildinii
MALKALVGQKIMNDAIRQKKKGKEVEWRVLVVDQLAMRMISACCKMHEISAEGLTIVEDINKKREPLPTMEAVYLITPSEKSVHALMNDFASPNRIMYKAAHVYFTEACPNALFDTLCHARLAKFIKTLKEINIAFIPYEQQVFSLDAPETFQCFYNPSLSNSRLANMERIAEQIATLCATLGEYPSVRYRSDFDKNVELAQIVQQKLDAYKADEPTMGEGPEKSRSQLLILDRGFDAVSPLLHELTLQAMAYDLLPIENDVYKYEATAGAPEKEVLLDENDELWVELRHQHIAVVSQNVTKNLKKFTESKRMPQGDKQSMRDLSQMIKKMPQYQKELSKYSTHLHLAEDCMNAYQGHVDKLCKVEQDLAMGTDAEGERIKDHMRNIVPILLDQSVSNYDKMRIILLYTLSKNGISEENLNKLVQHAQIQPHEKQAIVNLGNLGLNVVVDGTRIKKPYVPPRKERITEQTYQMSRWTPVIKDLMEDCIDDKLDLKHFPFLAGRAASSGYHAPASVRYGHWHKDKGQQTVKNVPRIIVFIIGGMSFSEIRCAYEVTNAVKNWEVIIGSSHILTPEDFLSNLANLSN

SEQ ID NO: 12532 - protein, 735 aa, Piezodorus guildinii
ITWLCYYFDLAGLNSTLFIMMQQYMKELEQDPYSYEDFVERLAWRTVDGFKEDGIHGFDPNLMHETFLQAIKDLQVLLDRQCKKCEKLELICKEEEANHFQDISHLQDKNKEAVALFQDLDERINFVATKVIHLGDQLESVNVPRSRAVEAQRLMTYFSEFLSPGPVLASVFSNKEEVFEAADIIQKLHMISQELPSDKFKDARSKISLKYDEIERSLIEEFVKSHRVHETSRMKEIANILMHFKSYSQCIDAFIEESQMGTFAGKDIFKEILPLTKKNFNIMKEVFSNPEQVMAKFVLNIYHLKLQKHIVSNLSDKSDSNKYLRNLMELYTRTTELSVELSCFKMGSDDSYLQKLTHTIFQKYLESYISVEVKGLKEKCSTLLQKYYDSKDHHKRQIQSGGFQDFRRDLQAVIGTRANINIAQIEDYGGETFLSEELVISLIQESKQAFYRCKLLSKPADLASNAVQLLEVLLNCIIIDHVDYAVELALQAVPIPESKTQAQPIYFFDVVRQTNTIVHLVEKHFNDSALPLVMSTSKHGECVMKKKFLLNHLEQKLDNGIDRALNAIVGWVKVFLQSEQKKTDFKPETELNTLSSPACIAVVEYFNDNVKHIRSCLDGRNIECVMTELGCRFHRVIYDHLQQFQYNSTGALCVICDMNEYRKCVKELNSVLVNTLFDTLHALCNVLLVKPENLDQVCTGDQLSLLDRSVVLNFIQLRNDYKTQKLSNFLKGMSA

SEQ ID NO: 12533 - protein, 276 aa, Piezodorus guildinii; identical to SEQ ID NO: 12307

SEQ ID NO: 12534 - protein, 164 aa, Piezodorus guildinii
EDNMNCWGISRSCGVSPVCNLLLFSSCVFIMSIGVPIKVLHEAEGHIVTCETKTGEVYRGKLIEAEDNMNCQMTGLTVTYRDGRVAQLENVFIRGSKIRFLILPDMLKNAPMFKKQGNKGNTGAGRGKSAILRAQAARGRGSQTRGGATSSRPSWQGGSNQSRK

SEQ ID NO: 12535 - protein, 487 aa, Piezodorus guildinii
WPPGHRSGPPPGPPPTAGPFFFFFFFSLFLISQFSLIFCSLKFKFYQMASSVSKVPLLQTLAKRTFAAAAAPKAAGCKATVEVSTLPNKAIVTSLGCGPKPFVQVAVAFRAGSRNECSENYGASHLLRSSAGLSTCGASSFYICRSLQQIGASLTATSDRETIVYVLESSASKINEGLDILKKAITGQEFRPWELSDNVSRIKVELASLPPQAKVIDLIHTAAFRSGLGNSIFVKEFNIKKLSSETLKHYAATYLTGDKAVIGGCGLPHSRLSHFADSLGLCAGSVGAIPASKYRGGEIRVEENIPLHHTIIAAEAPSLDKSEALAYAVLRYALGTGPSVYRGTGSGPLAKVSGHQVTAQALSMAHSDAGLFGIYVSSPGYCAKEVVEGAVKVLKGGVTDQDVARGKAQLKAALLYSSESCRGLVDDLVGQALLIQGAPPKTTADLAEEVSSVTTQQVQQALQKVQSGKKSIASVGSVGKVPYLDEL

SEQ ID NO: 12536 - protein, 112 aa, Piezodorus guildinii; identical to SEQ ID NO: 12423

SEQ ID NO: 12537 - protein, 496 aa, Piezodorus guildinii
MAISSSQAVKEHVLAVSRDFVSQPRLTYKTVSGVNGPLVILDEVKFPKYNEIVQLRLADGTLRSGQVLEVSGSKAVVQVFEGTSGIDAKNTICEFTGDILRTPVSEDMLGRVFNGSGKPIDKGPPILAEDYLDIQGQPINPWSRIYPEEMIQTGISAIDVMNSIARGQKIPIFSAAGLPHNEIAAQICRQAGLVKLPGKSVLDDQEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHSDVSNQLYACYAIGKDVQAMKAVVGEEALTPDDLLYLEFLTKFEKNFISQGTYENRTVFESLDIGWQLLRIFPKEMLKRIPASTLAEFYPRDSRHTTTK

SEQ ID NO: 12538 - protein, 742 aa, Piezodorus guildinii
MMQQAQSRPMSHGNYQGGPDLPMGSVKDQTLMWQQSSYLGDSGIHSGATTTAPSLSGKEEEMYGDQDMFDLDQGFTQGFTQEQVDEMNQQLSQTRSQRVRAAMFPETLEEGIEIPSTQFDQAQATAVQRLAEPSQMLKHAVVNLINYQDDADLATRAIPELIKLLNDEDQVVVSQAAMMVHQLSKKEASRHAIMNSPQMVEALVRALSNSNDLETTKGAVGTLHNLSHHRQGLLAIFKSGGIPALVKLLSSPVESVLFYAITTLHNLLLHQEGSKTAVRVAGGLQKMVVLLQRNNVKFLAIVTDCLQILAYGNQESKLIILASQGPIELVRIMRSYDYEKLLWTTSRVLKVLSVCSSNKPAIVEAGGLPALAMHLGHPSQRLVQNCLWTLRNLSDAGTKVGGLEGLLQSLVQLLDSSDINIVTCAAGILSNLTCNNQRNKVTVCQVGGVDALVRTIISAGDREEITEPAVCALRHLTSRHMESELAQNAVRLNYGLQVIVKLLHPPSRWPLVKAVIGLIRNLALCQANHTPLRDHGAIHHLIRLLMQAFQDTQRRSSVTSGGTQSGGIYADGVRMEEIVEGTVGALHILARESHNRAIIRGQMVIPIFVQLLFDEIENIQRVAAGVLCELAQDKEGAELIEQEGATAPLTELLHSRNEGVATYAAAVLFRMSEDKPQDYKKRLSMELTNSLFREDQNLWNGDLGMAPDLQDMLGEQNYDTMYSHGPPSVHSSHGGRGYQPGL

SEQ ID NO: 12539 - protein, 245 aa, Piezodorus guildinii
MARNAEKAMTTLARWRAAQLGEGDQAKQRRPYLASECTDLQQAEKWRMQIIREIARKVSQIQNAGLGEFRIRDLNDEINKLLREKGHWEAQIRELGGPDHSRSGPKMLDAEGKEVPGNRGYKYFGAARQLPGVRELFEQAPPPPPHKTRGELMRDIDASYYGYMDDEDGIIIPLEEIEETKAIKKAVAEWTVKKEKSMEMDEDEKEEVEEDNIYKAAGNKEGDEDDDDDDEEAGEEDGFELSAKL

SEQ ID NO: 12540 - protein, 214 aa, Piezodorus guildinii; identical to SEQ ID NO: 12427

SEQ ID NO: 12541 - protein, 176 aa, Piezodorus guildinii
FFFFFFFFFGEVKKTINMDIQTIATIFIKVLKLVINFIILMLYRYGGKQGFLGVGGTWNLYEVKSADAEIIASGVFVGFFIYTSVILISYCFGTTKHKYSAVDIIMNVSGTILFTAVGGIALHYWVGFQDENHYVGISQEKQIGLALGSLSVVCAAIYLLDTVLSCIHIAHKHAIA

SEQ ID NO: 12542 - protein, 778 aa, Piezodorus guildinii
MPRIMIKGGVWRNTEDEILKAAVMKYGKNQWSRIASLLHRKSAKQCKARWFEWLDPSIKKTEWSREEDEKLLHLAKLMPTQWRTIAPIIGRTAAQCLERYEYLLDQAQKKEEGEDGADDPRKLKPGEIDPNPETKPARPDPKDMDEDELEMLSEARARLANTQGKKAKRKAREKQLEEARRLAALQKRRELRAAGIEYAARHKRKRGIDYNAEVPFEKKPAAGFYDTSNEAIDPHAPNFNRLRQQNLDGELRSEKEERERRKDKQKIKQRKENDMPLAMLQNQEPAKKRSKLVLPQPQISDQELQQVVKLGRASYAAREAVTEGSESASDTLLNDYALATPNAGSTPRTPAPTTDRILQEAQNMMALSHVDTPLKGGLNTPLYNSEFSVHPPAEQITTPNTVLTTPFSNRTHEGRTPGFQTPQDVRNSLTTPVRDKLNINPEEGGDTPYAPVNNQKQAKEELAARLRSLPQPKNDYEIVVPEDEVSSETTAEGAGLPSVEDQADIDARNLSILAQQREKELKSRSQVIQRALPRPGDINIVLRPANTDPPLTELQKAEEMIKEEMITMLHYDAVHSGEPPSSRKIGTVSQAQHLAYLEQHPYHTYSEDQIEKAKEMLKAEMEVVKQGMNHGDLSLETFTQVWEECLAQVLYLPNQNRYTRANLASKKDRLESVEKRLEQNRTHMTREAKRAAKMERKIKIITGGYQTRAQALIKQLQDLADETDKAHMELSTFKLLQQQEESAIPKRIESISEDVNRQLEREKSLQKRFSQLQLVSQS

SEQ ID NO: 12543 - protein, 157 aa, Piezodorus guildinii; identical to SEQ ID NO: 12317

SEQ ID NO: 12544 - protein, 436 aa, Piezodorus guildinii
MSYSIVLSRLSRFPLISYSRGYNIAGHNVKNHSVSFRYYSSSGRRPNFFSQFIENVRQDLAKSKEMKESLKKFREEAQKLEQSEALQKARAKFQTVESEASKGGEVFREKLDHIKDKVSDVLEEAAKSEIGKKAGQLGAEIGKTARGAAETLSETGQQIGKSGAFQTISQTAAAVKQELDQTGIHAHVYQPPRKLRRRVEIMPDNKALKPDTETLGIDLHKDSKFFQSWQQFKDNNAYINKVLDWKMKYDESDNPVIRASRVFTDKVSSVMGGLFQKTELSETLTEICRIDPNFDRAQFLKDCEKDIIPNILEAMVRGDLDILQDWCHEGPYNVLAAPIKQAKEAHFQFCSKILDIDNVDLVMGKVMDQGPVLVISFQSQQLLCIKDKNGNIVEGDPNKVLRVNYVWVLCRDPSELDPKAAWRLLDMSAQSTEQLL

SEQ ID NO: 12545 - protein, 300 aa, Piezodorus guildinii
MTRPTLRELQLEELENYEAETDSDTEALQEAFARGDLKPGLNIPVKDRPRTNNVPLLMEALSEIKQELPWIERLDVTNDQAPLAPELALQIRDEEKGHNPLVYDELKRESVFYRQAQNAALKVLPQLKQLGLRTERPGDYFAEMAKSDQHMQKVKGEAIKKKLMMERIEKLREIRAQKKVQKALHAQAKVAKVQSKKQMLDEVKKYRKGETKSLAFLEPGYKPKPKANKSQIKRQHKNAKFGHGGKKRGAKRNTRDSTSGIERRPSKPSFANSAGKGKKVMKQKRPGKNARLKQKSKRKN

SEQ ID NO: 12546 - protein, 1263 aa, Piezodorus guildinii; identical to SEQ ID NO: 12521

SEQ ID NO: 12547 - protein, 665 aa, Piezodorus guildinii
MNTGPGGPNYPMASLYVGDLHSDVTEAMLFEKFSSAGPVLSIRVCRDMITRRSLGYAYVNFQQPADAERALDTMNFDNLKGRPIRIMWSQRDPSLRKSGVGNVFIKNLDKSIDNKAMYDTFSAFGNILSCKVAQDENGVSKGYGFVHFETEEAATKSIDKVNGMLLNGKKVFVGKFIPRKEREKELGEKAKLFTNVYVKNFGEDFTDDMLKEMFEKYGPITSHTVVVNKDGKSRGFGFVAFEDPEAAERAVEDLNGKELIEGKPLYVGRAQKKAERQQELKRKFEQLKMERMNRYQGVNLYVKNLDDTIDDERLRKEFSPFGTITSAKVMLEEGRSKGFGFVCFSSPEEATKAVTEMNGRIVGTKPLYVALAQRKEDRKAHLASQYMQRMANMRMQQMGQIFPTGGTGGYFVPTLPQPQRFFGPAQMAQMRPQPRWPAQPQVRPSTQATASGFPNMQGPFRSGPRGPGAAGGGGGPGSAAAAAAAMRSSISAAAAAVAAAGRPTANAAAAAAAAAANPAVARQLAQGASQGAPVSVSAQGRPANYKYTANMRNPPPIGGGAGAGAGGPPQQALHIQGQEPLTASMLSSANAQEQKQMLGERLFPLIRSMYPDLAGKITGMLLEIDNSELLHMLEHHESLKAKVEEAVAVLQAHQAKQAAASVKKE

SEQ ID NO: 12548 - protein, 913 aa, Piezodorus guildinii
MTDSKYFTTTKKGEIFELRSELNSDKKEKKREAVKKVIASMTVGKDVSALFPDVVNCMQTDNLELKKLVYLYLMNYAKSQPDMAIMAVNTFVKDCEDANPLIRALAVRTMGCIRVDKITEYLCEPLRKCLKDEDPYVRKTAAVCVAKLYDINPQLVEDQGFLDQLKELLSDSNPMVVANAVAALSEMNEASVNGTPLIEMSAATINKLLTALNECTEWGQVFILDSLANYSPKDEREAQSICERITPRLAHANAAVVLSAVKVLMKFLEMLPSESDFVSTLTKKLAPPLVTLLSSEPEVQYVALRNINLIVQKRPDILKHEMKVFFVKYNDPIYVKLEKLDIMIRLASQANIAQVLSELKEYATEVDVDFVRKAVRAIGRCAIKVEQSAERCVSTLLDLIHTKVNYVVQEAIVVIKDIFRKYPNKYESIISTLCENLDTLDEPEARASMIWIVGEYAERIDNADELLESFLEGFHDENTQVQLQLLTAIVKLFLKRPTHTQELVQQVLSLATQDSDNPDLRDRGFIYWRLLSTDPGAAKEVVLAEKPLISEETDLLEPTLLDELICHISSLASVYHKPPTAFVEGRAGLRKSLPARSGSAEVVQETPGAQVIPSQDSLIGDLLSMDIGGVSAPPPPPTTSAPVDLLGLDSLLGGVPEPVVSQSTTGLLGDIFGLGTAAGPTAYSPPKTIWLSSDRGKGCEISGTFSRRNGQIQMDMTFVNKAMQPMTGFAIQLNKNSFGVTPAGTLQVLNPLPPGTSHDCSLPLVTTGAVQRMEPLTNLQVAVKNNIDVFYFACIIPMHVFFTEDGQMDKRVFLATWKDIPAQNEVQYTLTNVQSNADTVVQKMQENNVFTIAKRNVEGQDMLYQSVKLTNGIWVLIELKIQPGNPNITLSLKSRALDIAAGIFQVYDAILHS

SEQ ID NO: 12549 - protein, 165 aa, Piezodorus guildinii
MPPKFDPNEVKTVFLRCVGGEVGATSSLAPKIGPLGLSPKKVGDDIAKATADWKGLKITVCLTIQNRQAAISVVPSAASLIIKALKEPPRDRKKVKGVKHNGNLTFDEILTIARSMRPRSMSRKLEGTVKEILGTCQSVGCTVDGKTPSEVICQINDGEIDVADE

SEQ ID NO: 12550 - protein, 369 aa, Piezodorus guildinii
MCGEEPKLGEMKALILVGGYGTRLRPLTLSRPKPLVEFANKPMLIHQIEALVEAGVTEVVLAVSYRAEQMEKELSDEAKKLGVKLIFSHETEPLGTAGPLALAKDILSSGNEPFFVLNSDIICEFPFKELVSFHKNHGKEGTIVVTKVEEPSKYGVVVYNEKGCIASFIEKPQEFVSNKINAGMYILNPSVLRRIKLEPTSIEKEVFPFMAEEGELYAMELNGFWMDVGQPQDFLTGMCLYLTSLRQKSPEKLYSGPGCIGNVLVHPTARIGTGCSIGPNVTLGPGVIVEDGVCIKRCTVLENATIKSHSWLSGCIVGWKSVVGQWVRMENTTVLGENVNIKDELYINGGQVLPHKSIAKSVQDPQIIM

SEQ ID NO: 12551 - protein, 287 aa, Piezodorus guildinii
MTLDGEETISDQEKVRIVSNFILHSPPGEFNEVFNDARILLNNDTLLKEGALGVFGQYCKDQLTPVKIKNSEYPVLITEHNDLGSNRFYDARSKQSFKYDPLRRETSNYDTWDAEPGTEKWRSALEVELDAYIAKHFESGSGSVFSKKEDGKVSLVACIEAHLFQPKNCWNGCWRSQWFVTIDSDNADVKGVLKIQVHYYEDGNVQLVSLKDINQSLPVVDEEQLSKALIKIFEDSETEYQQAISENYHTMSDTTFKALRRQLPVTRSKIDWNKMVSYSIAKELKPQ

SEQ ID NO: 12552 - protein, 1219 aa, Piezodorus guildinii
RDEMFLSGRSFVIIFTQARCGMKVITDRGDRFKSVERMEVALLLLFVTFVASKDVNRVSENLVRPYNKNYYTSRLRGGPGGLQPNADDDREAPSIDQPSIPYVITEDRLRKIRSNMMYWFFDRDSKGGYGDLQKDITPSITQVDKNLNFQLPFFGFRFNYTRVSLNGYLEFSDPPEQYSYPLTFPTVDWPRKNDPSFIGIFYSKCRIGQLGLNDVDQREPGVYFRMERDLISRKDKFGVEMRERLKWDIRESVVGSDSFEPKHSVIVTWKNVSFAGGIENSVQTTNTFQLVLATDEVFTYAMFNYVQIKWTTHTEARGDTVKGEGGVPAYIGFNAGNGTRSYEYRPYSQTSTIRDLVMRGWANGFPGRHIFRIDENILPGTCNKDIAGASLPLAFAPESGNMLGGTIVNITGPCFEPNMKIVCRFDMKAVYGTVVDRNRAICVQPFIMAEGYILFDIAIDDGKYVWKGQYFIETPATAAEKISFADDSVHQKYPPEVRITWNQYNLTSNLGAPVQISIWGYREISIRPELVYIDSLDVGVPNNGLYSIIPATYKNRDNRLFTDMSFGFIQINLTESTNYNGLKVTPVIWSKPIPLGWYFAPQWERQLGSKWPEGKCNTWIMNDRYLKNFPAELSICPCKLEHALADKGRFMPDFDCDMDANPHCFYHEGARHCVKTGAPKQEGSEQQCCYDKNHYLMLSYDQQWGSSPKRSSNLGILPWNEPNKVPTLSQWYHDIAPFYHCCLWQFEQSVGCETFRFERRPSQDCVGYQSPYIATVFGDPHFITFDGLEYTFNGKGEFVLLHTDSEKFKLDVQARFEQVGKNIYGEVAATQLTSIAARDNTSSIIEIRLRPKEAQWRYRLDVFANKKRIYFDRPALRVQHFTGVTVYQPSHILNQSEIIIMFQSGVGVEVVENVGYMAARVYLPWEYINRTRGLFGNWSFDPSNDFTLPDGSVVSADNLNNLERIHKEFAIHWRLEDNVEPNKGEALFVREYGRTSSYYLNRTFVPEWKSTPQEIIPPNRTKDIQQALALCGESYQCRYDYAVTLNREMAFYTLNYYSEFTQLRQTNKDRVLSCGVLETPRFGRKSNFFFVPDSKVIFECDQGFILVGDQRRTCSSTGRWSFDYGYTECLREEEYSLRAFGWTWGIIALVLIPIVIVLVCAGFRIVRRIIEQKKNELRTDQRTQYHPDYSAGPIRYNAREVSLAINPESEPLKKETEVN

SEQ ID NO: 12553 - protein, 113 aa, Piezodorus guildinii
MRYVAAYLLSSLGGKEAPSAADIDKILSSVGIESDSERVNKVISELKGKNIEEVIAAGKEKLASVPSGGGGAPAAAAAAPAAASPAKAAEEKKEAKKEESDQSDDDMGFGLFD

SEQ ID NO: 12554 - protein, 913 aa, Piezodorus guildinii
MMTDHIGGITLKWDPKNLEIRTLSVEKTLEPLVLQVTTLVNTKGPSKKKKGRSKRAHVLVAAVEKATENFIEKGEMIAYENPDIKQEMLSAVEEVRKTGEAMSAAAREFADDPCSSIKRGNMVRAARNLLSAVTRLLILADMVDVHLLLKSLRVVEDDLVKVKNASSQPELLENIKAFGRNASELMSQAAKRQLELKDSQLRDDLAAARAVLKKHSTMLLTASKVYVRHPELAAAKANRDYVFKQVCEAVNTISDVAQGKGPSITTNPYEGPGELAAALDDFDERMVMEPLAYSEVATRPSLEERLESIISGAALMADSSCTRDERRERIVAECNAVRQALQDLLSEYMANMSVKDQSEGLERAIDHMCRKTRDLRRQLRKAVVDHVSDSFLETSVPLLVLIEAARAGNEKDVEEYALVFQEHANKLVEVANLACSMSGNEDGVKMVRYAAAQIDALCPQVINAARILGARPKSKVAQENMDVFRDSWESQVRVLTEAVDDITTIDDFLAVSENHILEDVNKCVMALQEGDGDSLDRTAGAIRGRSARVANVVTAEMDNYEPGIYTERVLEAIKVLREQVMPNFAQRVEVAVDALSSNPPKDVDENEFIDASRLVYDGVREIRRAVLMNRTDEELDPEEVELDEHYTFETRSKSSAHTADHGVDEYPEISGITTAREAMRKMTEEDKQKIAQQVEYFRTEKLKFDREVAKWDDTGNDIIVLAKHMCMIMMEMTDFTRGRGPLKTTMDVINAAKKISEAGTKLDKLTRQIADQCPESSTKKDLLAYLQRIALYCHQLNITSKVKADVQNISGELIVSGLDSATSLIQAAKNLMNAVVLTVKSSYVASTKYPRQGTVSVSPSPIVVWKMKAPEKKPLVRPEKPEEVKAKVRKGSQKKIQNPIKALSEFQSPAESV

SEQ ID NO: 12555 - protein, 412 aa, Piezodorus guildinii
MNESNLQSTPKTNASTGFFQATTPKQGSSVSFGSMSTNQTQQTGFLNFTPQVGTSKQSTMFMPPTALSGTSTPKTTATGTATLFNITTTTASAPISSSSATTSGFSLGSSSAASSQQFKPPSTSQPMQLKTTVSGASMPLTTGLSSTGGNTQATAGLNFGSTAKSTPGSTVFSPAKSSLPAASSTTTSSLTLPPSSTTSLTNSLSNKPVTSTGASTSQQPNNLTFQQLEELILNKWTAELYEQEKVFLNQATQINIWDKVINENAEKLTQLHSTMEKVRKQQAKINDDLEIIFTHQKDLEACLVPMEKEDLLSVLKADPNRKNLYINAKKIDSQIKTMSEDLKETIEHINETSRSHDTEDPVIQVGRILNAHMESLRWIDEHTARMQDYFDSLLKMHDDLRRECEISKHDVY

SEQ ID NO: 12556 - protein, 193 aa, Piezodorus guildinii; identical to SEQ ID NO: 12443

SEQ ID NO: 12557 - protein, 596 aa, Piezodorus guildinii
MSGNNVYGEMLLTVTSEKFYIEPVQDIDNSLILDRVTGNITISNVPGSSGDAPMIGEKKTIYGILGTIRLLAGQYLVVVTGRTKIGNIWRREVFQMDSAEILCFSRSTTHLNDKQKRIEKEYISMLESILATPHFYFSYSYDLSHTVQRLHNISPDFLKMPMYQRAEQKFVWNEYLLSEFAQNSGVSKFCLPIIHGYLSITSCILNGKTFSLILVSRRSKERAGTRLFTRGIDSNGNVANFVETEQIVEAKFERASFVQTRGSMPFFWQQYPNLKLKPRPAIIQDENHSAAFSKHFETQLMDYGRQVIVNLVDHSGSEGKLEEFYRKLVNEANNADLKYEAFDFHRECSKLRYDRLKILIDRLAYDLEQMSVTMIVGDGTVISQQEGVFRTNCIDCLDRTNVVQSLLARANLTYILQRLAILKKGQTVEDQVGLENTFKVIWSDHADLISIQYSGTGALKTDYTRTGKRTKKGMIRDGVNSLVRYYKNNFQHGFRKDALDLWLGHYRVSSEEGIIIRSPLDVKREFKYTAFPLILLVAIAMFFANLVTPNEYTTGTLLSLIFWCSMVSATLIAIFYNGSEYVDCPRLCPLLRSPSV

SEQ ID NO: 12558 - protein, 433 aa, Piezodorus guildinii
MSPTVPTTTNVVDKRPTLVKPHSAERRSELVCRVKYCNTLPDIPFDPKFIQYPFESTRFIQYNPTSLERNYKYEVLTEHDLGVTIDLINKDMYAADHNAVLDPADEKLLEEDILTPHDSKRSRHHSRSVSWLRRTEYISTEQTRFQPQVMDKVEAKVGFSIKKSLKEETLYMDRESQIKAIEKTYDDAKLPIEKHHSKPNVVPIEILPVFPDFQLWKYPCAQVMFDSDPAPIGKTVPAQLEQMSQAMIRGVMDESGEQFVAYFLPTDSTLEKRRRDFTNGIDYEDEEEYDYKIAREYNWNVKTKASKGYEENYFFVIRNDGVYYNELETRVRLSKRRQKAGTAPNNTRLVVRHRPMDANEFNIHRQREKQLQHPIEEEDEEESAGEEEKKEEEKKSNSKDSDESDKDEGSEKEGGSDKDEGSGKEDGSGKEND

SEQ ID NO: 12559 - protein, 400 aa, Piezodorus guildinii
MDNEGVTPAYMKLAQIKFALSLPEYKGDLALKEELLNGIKAGNMAPYYREVCNDLGWVMDETLCAQMAKNNETRLAELEKEHENSVIEDEEQVSGLWQAKLDYLCSIGDKENASTLANSKLQDKTVPKTHRIDAVFALFRLSYFHGCDIKGMSSAIEKATELIEGQGDWSSRNKLKAYEGVWSFAVRDYLRAAKLFVDVVPTFESYELADFGTIIKYTVLSCMIALPRCELKKKLMHHGVMAQALHSQYRNLKEYFQSLYDGHYADFLVALAQVESDMKRDPLLHPHYRHYVQEMRLRAYKQILQAYRSLSLDYMAEAFGVSCEFIEREVAKFAASGRLQCKIDSVARSVITSVHLSDEALRVKDSSDLDLDRSLLYKTTVKRGDILLNRLKKLARVMDF

SEQ ID NO: 12560 - protein, 4112 aa, Piezodorus guildinii
MEEGSGDREGKSGGGEEDMDVGDCSEEEEDEEEDLEMGSSPMQQEQSSIMDITSPASQPYEGLASTLRMVPPTVLSAGKPLQGTSGLKRGPGRPRSRGAGGNSAATPRPIKKPAVGLKLKRWKGLLVSGVYGAAGGKGGGEGDPEGESTSPSQPSTPVDQLKGPIFVDEPLFDEQWPGKLCVLCNLSEHSQLGQGKMMRAECSLEDLPRDLPRESLMSPPETPPPIDSFSPRPPLQNRRQKGFAKFSGQEPVEELSLVGHIDIPEPSNLIDSGYIYVHEWCAVWCPGVRRDESGQLLGLVVAVAAAATRRCYHCSRYGAGPPCIVPSCNKHFHIPCAAAASAFQHVRTLTLICSQHLDHVANSSSMSNVTCPSCNSLGNVANLVMCSVCGNHHHGACIGNALHPGLRAGWQCIDCRVCQLCRENEETGRMLVCDYCDKAYHPHCVRPAMSSVPKVGWKCKRCRLCSDCGARTPGGGLSSRWHSNYTVCDSCYQQRNKGFSCPVCHKAYRAAALREMVKCSQCRRFVHGTCDKEADFVSYHRKKEAHPDYQYICLSCKNNSTILYLKRKDSTEDVNMDSALNISQESLATPDELDMDSERSDDPPFRPSGVGLGKGKPFYASKIAKKKLGLGPGRPKGSGKMSSIALPHFQKRPRYADFGRKRGAKTKMRGIFGVPGLGLQRPLMDSNTKPEDEPGLENKLVLVSSRDKYVLSQDVCVMCGALGQDQEACLIACAQCGQSYHPYCVSVKVTKVMLQRGWRCLDCTVCEGCGQRNDEGRLILCDDCDISYHIYCMDPPLGSVPTGVWKCKWCAHCQTCGSNNPGPNSTWQSNFTQCGPCNSRTVCPACLELYTDGDLIIKCIHCDRWLHCLCDTISNENEAEACCAQGYTCILCRPNNAALVLPATTPSRVPSPELNTESRATDYYVDGVCLSETGLQLIKTLSMDNGNQPVRRKRPGFRRQDPSVDLVDDMDNEGKDTVYKDGMFWASKENGPIPSPPEGFTLYTRESGIVVLKRIKKRNLQRLGIGGFTTVKMRSSRLKEDDEHLYPEEKPRRKPRVPKKKSKIAESYPRHLQEAFFGKELLDTTKETSQELESTGDESDDGKMREEEGSDGETLKDILHLPENLLHNDLVNTIMNESADSIKSENLMSESGHEGSSSQKDELCDILGPHFNIESMVRETGLPNMDSKDVEEIFKGVLTDEARNQAHHNQASPQQQHPVAKSAPAGLASSPLQYPSASPYNSEYSNSPQFSPESSWDDCGSYNRTTSLKMEADESLGRDATISPVLYANINHPEWKKEYPSWNERFKQILKQWRALSSEEKAPYLQRARDNRTNLRSRKQEHDKTLNTKSCREAEQERQWKELQALRQQQQHMLSQTRVQQVNRVRQVGNAGLVQFSTNDQSPSPHLTQQLQVSTSTQEANLGGLASPRAQFASGTGGTVKVATPGGTIYRQVRPPQSPFPSPRQPSTPQQQEEVRQLRDLLQRHQVKQEGSETVLSGGVLQAVQMRPQPPRSSLHPQVVHGMEPRVRLVVQQQASRFPGTTQVRLAAPRTQLQEQFLIQRQFAVAPAAQHAHNASAIIRNSSTLVEQTRLQTLPVDQRIQSGGREGEEIPESVTAELEKLEEEGGTIGGEADEVSAIFSDLVEDDDELLAEMGSDFNILEYADPELDNVSGGEKTNILDDLEDEVEKKKQVGASRKDNSVQRNSSESINKELSEPRPESKPSEEVSRVSVTSTPPHLPQQISLSGNNGIVQPKIVGSGYQTQFATPSTPLPRMQVLQGANQVNRGGASFVGNPPPPPPPYPGPPPPYPGQQAAIRGRGVVRSHIISSQASQAQQRRTLLLQEQPLLLEELLEEEKREQEKASVTPSPASSLMSDADFEMLRADVLGSRTASPPQSQTLGTLNLVGPPPPPPPENIVTEADRQAQIQYETWLRTTGSAVSQQIRYFETEVQKLRKIRKSLNSKQRQLRKNGNELNEKDANELQRVTGEQTTLQKHLEAARKQSRQHTMVMQEYQTKQESKGGGGSAGSASPQSPLLSPAGGGVGGHQSHQPSPQTSSVSPVRHSPAGTPHSQSGDDKSESSGLPSPRPPPMTPTPPSPHQFHQIRHPSMVPRFARSPEGGLRPRLAPLQTSGFNSPRGMSPQPPSPQTMRLTQQQQLLLQRHQLQQQKQQILEQHPEAGAILSRQLMRQEPQRQFRNFPGPQSPGSQGGSPLYSPRAPPSPMVYQGLQTPTSPMPQFTQPTSPMQSPRLQYAPSSPHQQQYRPNSPMVPSPMRRPSSASPQGENPGGGGNPFNPNNPIPIPPEIRRLKLGLKGGSPMWNEQRKRVQPSTSSEKVATSLVCADYNDFEEESPPITPPSKPALIKKTETVKARQSEDTDSELTVYDDIVLVEGCKETNLEVAELRSALEGNVMSTVVSMPMVIDSGQIQMMDVEGELLDDLVVLGVGNGTTDSDCILEVNKDLILDDDVKEDELEDGSPPRARMQGKVLPGGGSHNSPSPESRNNCDIFKKVEEKAKKLEKERKSTDERTVPVQPNIVVSRTPTTFTPVVTQKSIPIADNRQLAMQQAAVASLVQDAVNAAKLAAEAQNYLKASQGNDQHRNAISRGSFVPLSVITSKAVDNEPLVNNTIKTDVRKSEMNRFSEADNGQKEPENKPEQQKFRLENANDIRIINTDSSIIKYKTSDSVERHLVHNEINVIKENEETNDKRDHKLPERMNHVSTKVENVTLPCVSSSILEAQLTSMLRTNSEPSSNQNFIYAVVNHTVKDQRREENNQDDMRVEGLAAHFQRTVKNEELMLTDSDMYKNSRNPLLNKKHGNIYVSSQLKTDTVMVGGKSYKIYQAGPQSSTSDILTLRDDKEEANGRVAHKVNTLERRLSVNNEKSANEMLQQRVVSSSETAEKETHHLSFGGPKTQVVAQKEEPKKFVALATMLLPRNNEEKRVRPGEDSQNVLLKQLLQNTACATTTASLPIVPSLEAQLARPVPPTPSSLLPSVLNEPPKEIPQPKPQQQIIESPKQESRPHIGPSSLDELLSPPPPPQQLQHPPSAIQTSPIIKREPVFSLSQPGPVMTPMVDVKREVEVKKEVMSSDEMLSPGLRLDQADSQPQDIKKLKKRPYHHQKRRQSLGKEMIGGTPKKRPRKSSKVEEDYDSFIDSVMHQLRQTPGMSICEPNLTYNFTGCPPFGAGDMSKVNSCTRLGELRGMYGTAYLPHENDHYNTLPFGDLPPKAPSTPATQRGFYNEEFAPLKLHTAKDDFDDRKYDYNRDRDNDTPDTIVSSSSPECIMPEFHPRFPGLQLIDSDNEEERFRLSRFSPDIPIIAPLAIRPKPIRFYSDMDKENETPDGERGRIRESVTVTLTLTSQAADDVLSVLRNLANVLRIPVPATHSITERSSASHRLGIYRLKGKDGKEGAQVDIQSILNGTAKFCRHCDVVIMNNLMRKKASEMPLVARQGEEDLYFCSTSCYMQLALSHSQGPNKDKALTIIDHVETPSKKTKVESTTDCSAVKIEPKKEYNLSSDPTYMTTRGSGKREKQSSAYDKMAVTNSYNTLGKKSPSRYRTWTTATIPPPSARHKKPTDKEITEMLFKSGITVMPLKLPEDSRHCLLCHQVGDGVTDGPARLLNYDVNKWIHLNCALWSDEVYETVNGGLMNVEIALQNGLSVHCAYCNTTGATLKCYKMRCSLVYHLPCAVKDQCVFFKNKTLYCSSHVPKNEKENELTTLSVMRRVYISRDENRQVAAIMHHSEQTSLLRVGSLIFLSVGQLLPHQLQAFHTPNYIYPVGYKIIRMYWSMRTVNKRCRYICSIADVEGKPEFRITVEERGEADMELRDTTPRGVWLKVLEPLAELRKVSSVVQLFSRYVTGEDLFGLTEPAIVRVLESLPGVETLSDYKFKYGRNPLLELPLAVNPTGCARSEGKPKGWKRAHTQRATSLRGGGSGPAFPTSAPLPGELACPYSKQFVHSKSSQYKKMKQEWRNNVYLARSKIQGLGLYAARDLEKHTMVIEYIGEIIRSELAETREKQYEAKNRGIYMFRLDEDRVVDATLCGGLARYINHSCSPNCVAETVEVDRDLRIIIFTKRRISRGEELAYDYKFDIEDDQHKIPCMCGATNCRKWMN

SEQ ID NO: 12561 - protein, 1092 aa, Piezodorus guildinii
MSEDSENHRARPKRNLSAKQKKLELLEKLKSGKKNKYDIGELENVYEEVDEKEYTRKVLERQDDDWIVDDGGCGYVEDGREIFDDDLDEESIKKSQSIVTGRKRGRDIAPEKKGNIRNMLAKMPSKKKKKETSVKLEEDDILGDIIGEIDSTSVAPLQNGNKKPVISEKDYLKSLTNFKQTSHKASPVKRAKISSEVNPLPLVKETPPKKLVDVPVETSPIKIKEEPIDVDEIQDYSCDMFSDDFDQEVIEISDTKDNEVCSRDIKVEPASPVKDASPVKMEIVKDEVSEEWDKQIEFDSPVTYVNVDKSKLPLVKNESGQEVLRFYYWDAAEEMYSQPGTVFFFGKILIESANTYVSCCVSVKNIERRIFLLPRERKMNLKTNEAYGDPVTMTDVYQEFSSTVAEKYKIKQFKSRKISKKYAFGDSNVPSESEYLEIRYPCTSTALPSDLKGETFSHVFGTKTSFLEILLLERGIKGPSWIEITNAEPVLAPFTWCKVEASCMKASDVNVLKPGLPHIPPLILVTLHPQAVHNPKTKQTEIVAVGCLVNNSYHVDKPSSDRLFNQHFCVFSKPSDLTWPYDLKEHLSNFKKTSLERMESERALLNLLLTKLYRIDPDIIVGHDLSGYGIELLVKRLAFHKVPNWSRLGRLKRSVIPTTKARNQIEKIALTGRLMCDIKVTGKELIRARSFDLDSLCQLVLNFQENKRQDFTDEEFKSCFYSGENLVKALWSIMTDASYILRIFNELNALPLALQITNIAGNVMSRTLMGGRSERNEFLLLHAFHSKGYIVPDKEYKKTTKDDDIDGTAEVTTSSRKKPSYAGGLVLDPKVGFYDDLILLMDFNSLYPSIIQEYNICFTTIPPSSIDMDEDFNENYQKYFPEETVEPGILPTEIRKLVESRRDVKKLLKSAVSPEQKMQYDIRQMALKLTANSMYGCLGFSNSRFCAKGLAALVTAKGREILLTTKRMVESFGYEVIYGDTDSIMINTRTKDYEQVHQVGKKLKFEVNKCYKQVELDIDGVFKYMLLLKKKKYAAVTISKLPNGEFVEKQEMKGLDIVRRDWSQLAAAAGRHILNEILSNKSSDDRIDGIHN

SEQ ID NO: 12562 - protein, 466 aa, Piezodorus guildinii
MAAGTQVKNVEVRDIARIERIGAHSHIRGLGLDDSLEARAVSQGMVGQQMARRAAGVVLGMIKEGKIAGRAVLLAGPPGTGKTAIAMGISKSLGKDTPFTAMAGSEIYSLEMSKTEALTQAIRKSIGIRIKEETEIIEGEVVEIQVERPATGVGAKVGKLTLKTTEMETVYDLGNKMIDALTKEKVQSGDVITIDKATGKISRIGRSFTRARDYDATGPQTRFVQCPEGELQKRKEVVHTVSIHEIDVINSRTHGFLALFSGDTGEIKPEVREQINTKIAEWREEGKAEISPGVLFIDEVHMLDIECFSFLNRALEDEMAPVVIMATNRGITNIRGTNYTSPHGIPIDLLDRMIIISTSQYRESELREILKIRCEEEDCELSDDALTVLTRIAMETSLRYAIQLITLAGLVSRRRKSNEVEIEDVKKVYSLFLDEGRSTQILSEYQDQYLYDQKPDVGGGGEPMDM

SEQ ID NO: 12563 - protein, 369 aa, Piezodorus guildinii
MSIRTYGDKPISFQVEENGEYYCIGSEVGNYLRMFRGSLYKRYPGMYRRTLGNEERKRLIELGLSSHCLASSISLLRASEVEDIIEGNDEKYKAVSVHSSETPITSSSKPKKAMPWVPSLPNSSHLDAVPQATPINRNRVVSKKVRSFPLCFDDTDPSSIMENASQMEVLVPIRLDMEIEGQKLRDTFTWNKNESLITPEQFAEILCDDLDLNPLSFVPAIAQAIRQQIEGFPTDNILEDSSDQRVIIKLNIHVGNTSLVDQIEWDMSEKENSPEQFAMKLCAELGLGGEFVTAIAYSIRGQLSWHQKTYAFSESPLQTVEVPFRPQSEADQWCPFLETLTDAEMEKKIRDQDRNTRRMRRLANTTPGW

SEQ ID NO: 12564 - protein, 217 aa, Piezodorus guildinii
TAAPWARNVHLVVLGVALSGYCFVMAAIRKKLVIVGDGACGKTCLLIVFSKDQFPEVYVPTVFENYVADIEVDGKQVELALWDTAGQEDYDRLRPLSYPDTDVILMSFSIDSPDSLENIPEKWTPEVKHFCPNVPIILVGNKKDLRNDPNTIKELAKMKQEPVKPEEGRAMADKINAFDYLECSAKTKDGVRQVFETATRAALQVKKKKRNRKCKLL

SEQ ID NO: 12565 - protein, 1327 aa, Piezodorus guildinii
MNLSLSNYERVPPLDCYQPSGNLLDLADRMLEKFTQEDNNLPQLLDRLQITCESGTTSSGTKDTDYINNVDSSYLSQISQFRLINKIPLPQEISDQFSTLAAGSSGDTTIMGMFPEINRAWMAVESDIYLWNFETGGDVAYFDGLSDPIVSVGLIAPRPGVFQSFISHLLILTTPVEITVLGVILACSSDRKVGDELQLTPDTIYTLSTDGVPIRVIKGTKSGRIFLGGKDGNLYELVYRKEMSWGGKRAWKVNHTKAILSYLVPTFVSGAFSEEDQITEITVDESRNVLYTLSIKGSIEVFDLGRNGDTTCRVASLHHSFINRCTVDLIRKSFYFRNITPPEVSRVVSLCPISENDSPHFGVVGVTENGIRLYFTTGSPPRPSTLSLLHARLPPGHAPNTANVRIGRVAMSIHKSGTFIMVSSMGDYSPDRLWCFTMDGLSALKLPLTEFVFTNPQNAAIAIAESRENMSLTDRGLHGHFLVYQQNYPQDRFIILSQQGTDIYEKLRPVDIFGELMREKGGPDCEEVKQFFAQHGSDQACAMALILACDQTNQHMAEWATRAFFLYGGDPKYVLQTIQQPLQPSAVNNPLQQTILHHTLPLGFKPGTVSTPLGEKQTQPSRSIETYGVSMSSKHNGLYIFLSRMLRPVWLRRVLDVNYNKKPIYLPTITCEELSLKTVQLFELRSFLARYTLSSSDVGSSLQPANNTTVVSPSGQRTRLQEALIQEKASLDALRNFVERITQVFSLWKLLCDHELPLIVESLSPESQDQLIHITFRELILKGEDLCHELISKLVSLYLNDNASVDPISSKLREVCPLLYKNEDATCTKVNEILQMALEEIDEEAKLNLLRSAIDLCKNVSPNVDIDSVCKSLVKCGYYDGVLEMCQDVASKSDSNSLASKFIARGRPVEDVEGSKAFEARHKAYQQIVHLLDFLYQQCQLGGNNIPPLFGSADLSSHSQKLLEATLEKCLSVEDETCHIVVYDWLVSRELQASLVSLGRPSVERFLSRYPVDSSLRDLLWQYHEKSGNHAAAAQILYKIATAPGEFITLHQRLTYLGKAVMCMRSDGVGCASHLGVFLHELEDLVHVARVQKQILERITSMPDANDINVQDACRKLNANLLSITELYESFAEPFGLWEQKLAILDCAGHDDKELINSIWDNIILKELDQCNSRDPSGQMVVLVSKVRSLGLQFGIQSPCFPIEYLVWQLELISCKLGVDKFHVHNIMTSLGVPYSTLLDIYSKMYSANDNCWLESDNEFHLIQVIASFCESFCDNKQLTTSAQERKSTAVQMHDLINECIIVLHSKTGLGELVGYLKSIQTKLERI

SEQ ID NO: 12566 - protein, 1207 aa, Piezodorus guildinii
MSGSDFYGADTLHKEVYIRKGHEDWNEISLNPGGIASTLQDIKTQQRAGAYAYKKIPNRFIYWRTEGNVLEIVEECLDITLHGNQIRYKFTDSQVLDGLAIVETMKRLIILVPTVSSLHVFTYPHPEKLLKKGFGEVSSLSVFHGISENDATDPQTYYQLNCSSSAIVSCTSCITNNGEAIFALGLANTSVLLVNIDSVSGSSSSRILSHDNIVPRFLTGILGKDGGEWVPICLILHYIKKELFLFSLCRGGSLRVWSVDRGSFITSLCVKSTSQTTLKAQKHKMCKGYINGTFVLHCCVQGAAIVTLAPDYDNGTFNFTTISEIPIQPGFEVTNMCPGEEGYFWCSWLTLDESPAVTKNNVIHPGFSKVALTRPSLQVPVSDYIPRDPASHYLDAIFSSGFFTSLDIAKAISLYKITAVIKPNIDVAEQICAIVETEIYSEIGEQELDDDEFLDIAFRCWNRLYSCCSQYIISSMLPLGMVWLGDYLVLIQECGFSIVVDIEPLELFMTTGVKSSQFPQVGYGWLVERLRDINLDPGIEKLELSLHTGESIDELSVLQEAADLISPSKQLDDALSMFYEEGLSRSLNSLIEELAVPEDFNKDGSWESFCSYSGVGAVTSAFRDYVAVRLKICEKILLITELAMRDDDGAADRTQHRSLAALCKAYYILKWICTSKSTGNAPLIHVFSLVNPTSIMQSSLEQCVLGLANCLWPLATNCTLAQHLLSTKQYSLLQTLARLVGINNWSLLLAESYILTGQPGKAFDVCLKNAGSDVVHFLNAIRLFEKHSRSDLVIAMATKALELLIVSHSDRETLESALFIHELGMENYDAAWSWIESCSSWSRRSDFLQRLVANMISEGKLTDLISFSYTGLLDELEKLLASRARSLTFGLATNYYNILYAFHVKHENFKKAASIMLEKALRAETAEVQWKCYGACLSSLMLINDSKQAWLVRPNPFSQEDAVEILEIEDIQREFELSGARFNLDGCSPDASQEEVIALCVSQKQYKTALRLATMCKLSCAPCIQAFTASCVALSEQSISWHWLKANEIDDIIITESNATEMLWRILERCIMKYEKKNETVLHRACANQFLTVGLFIPTWLLQSYKKRNSSELLRMFVQHGYLEEAEELACEYLNAALGIGRENFSIDFPLHLSSPPLCLPLQTIDVLLLELKHYNIGERLQKKLDTYVSTISRITLERPMMLPTKY

SEQ ID NO: 12567 - protein, 966 aa, Piezodorus guildinii
MEISEENLHTLSNYLMQTLSPDPNVRRPAERFLESIEINKNYPILLLHLINKEEIHYTIRVAGAITFKNYTRRNWPVNDDNLENKIDPEDRQRVKELIVDVMLVAPSSIQKQLSEAIGTIGKCDFPKDWPGLLTNMVEKFAGGDFHVINGILQTAHSIFKRYRYEFKSQKLWEEIKFVLDTFAKPLTDLAVATQNLTQVHAANPDALRVIYSSLLLISKIFYSLNFQDLPEFFEDNMNVWMPLFHTLLTADVKCLQTDDDDEAGILEQLRSQICSNVSLYAQKYDEEFQPYLQGFVTDIWSLLVTVSLQPKNDLLVSNALQFLSTIAERQQYRHLFEDKNVLTGICEKVIIPNIHFRDADLELFEDNPEEYIRRDIEGSDVESRRRSSSELVKVLAGHFPETVRTIFGARLQEMLAEYNSDPAKWRLKNTAVYIVTSLAERGSTAKHGVTKSSDLVDLHDFAGQYIIPELKKDLNTLPVIKADSIKYLITFRSLLAPQVLITALPDIVKHLASPSLVVHSYAASAIDKLLTLKQNNQPLITQTLLQPIAGDILTGLFNILNFKGSEENEYVMKAIMRSFNTLDESVIPFLAELLPKLTQKLTVVAKNPSRPHFNHYLFETISLSIRIVCKNNPGAVGAFEEALFPTFQIIFQEDVQEFVPYCMQVLSLTLARRSPPLPAPYVALYPCLLSPQLWERPGCVRGLVCLLRSYVRVSSNDDFNQTVKVNGLLGVFQKLISSRLNDHEGFYLMQSLIEHCPRELLDPFMKQVVLLLFQRLTAAKTTKYVKGLITFFCLLVVKYGAPTFIELVDSVQPQMFSMVVERLITPDCRKVSGTVERKITAIGLSRLVAESKQVFSGPYSACWPALAKSVVEILEAPEDDSVAPEDHFVEVDNLPGYEPAYVHLTAVGNDKHDPVPDVTDLRREFANGIRNLLQVSGQVVTQAIASLGEPYASHIKSYLILVGVNI

SEQ ID NO: 12568 - protein, 191 aa, Piezodorus guildinii
MAKVQIGNVLVLDNPSSFLNPFQFELTFECIEELKEDLEWKMIYVGSAESEEYDQVLDTIYVGPIPEGRHKFVFQADPPDVTKIPIEDALGVTVVLLTCCYRGQEFVRVGYFINNEYSDPELRENPPPVPQFDKVVRNILGSEPRVTRFKINWDDSESQDQPSQESEEQQQTTENVAFAENSGSHNFMEVS

SEQ ID NO: 12569 - protein, 336 aa, Piezodorus guildinii
TITYCIICCQQNNTIIVFIISHGVLFTFLIFNFHPYIKMDHMLASPFNLPSIGTPVHQPEEDQQILPIAQQQQQQQIQPPLQMPPLLPIQSSINQPKPMNTYAPSMGFTTPQSMMHPQTPQNLMSPMVNRMEQTPNNIINPTTPGPMTPMTPSSADPGFMPQLQNIVSTVNLGCKLDLKKIALHARNAEYNPKRFAAVIMRIREPRTTALIFSSGKMVCTGAKSEDDSRLAARKYARIIQKLGFQAKFLDFKVQNMVGSCDVKFPIRLEGLVLTHGQFSSYEPELFPGLIYRMVKPRIVLLIFVSGKVVLTGAKVRQEIYEAFDNIYPILKSFKKQ

SEQ ID NO: 12570 - protein, 160 aa, Piezodorus guildinii
MASVGTTRSVLRLLSSQPILKQAVRGYADEMAFTFAAANKVFYANSNVKQVDVPSFSGAFGILPKHVPTLAVLKPGVVTVFEQDGSSKKVFVSSGTVTINEDSSVQVLAEEAHPVEDLDASAAREQLSKAQADLSRATSEIEKAEALIAIEVAEALVAAA

SEQ ID NO: 12571 - protein, 311 aa, Piezodorus guildinii
MPSDEQDKFDGMLLAMAQQHEGIKDLLDTFFSFLARKTDFYIGAQADAARSLVIDSFEKYQSKANLAAERKRTENAEAEKKRKERLAAKATPKVMEISDEEAQKIEDEEKKRKEEEEKALSKPITETEGEDDEQDKGKLMPNAGNGADLENYRWTQTLQELEIRVPLKTTFTVRSRDLIVDLGKTHLKIGLKGHEPLVDGELEHEIKIEESTWVIEDGKTLFLTVEKVNKMEWWSKLFATDPEIATRKINPEPSKLSDLDGETRGLVEKMMYDQRQRELGLPTSDEQKKKDMLKKFMEQHPEMDFSKCKFS

SEQ ID NO: 12572 - protein, 142 aa, Piezodorus guildinii
MTTPWSPDKKHSDRERWICIYPAYLNSKKTRAEGRIVAKEKAVENPTYQEIRDVLSAAGLKVGVENKLYCREKSKELLYRGRIRVQLKNDNGTPLNPDFATRESVILHACAMIPKLKTRQGGKHTTEQGQGGTSKKKGKGRR

SEQ ID NO: 12573 - protein, 676 aa, Piezodorus guildinii
MEKPQKMPKVAKVKNKAPAEIQITAEQLLREAKERDLEIVPPPPKQKISDPEELADYQHRKRKAFEDNIRKNRMVISNWIKYAQWEESQRQVDRSRSIYERALDVDHRNITLWLKYTEMEMRNRQINHARNLWDRAVTILPRANQFWYKYTYMEEMLGNVAGCRQVFERWMEWEPEEQAWLTYIKFELRYKEIERAREIYTRFVMVHPDVQNWKRFASFEERHGFISGARKVYERAVEFFGEDIMDERLYIAFAKFEEGQREHDRARVIYKYALDHLPKERTAEIYKAYTIHEKKYGDRTGIEDVIVSKRKYQYLEEVRTNPNNYDAWFDLLRLVEEEGNVDTIREMYERAIANIPPSREKDMWRRYIYLWINYALYEELEAEDEDRTRQIYRTCLDIIPHKTFTFSKIWLLYAQFEIRHKNLSTARKTLGMALGVCPRDKLYRGYIDLEIQLREFDRCRTLYQKFLEHGPENCITWMRFAELETLLGDTDRARAIYELAVNQPRLDMPEILWKAYIDFEINIGEARNARQLYERLLERTHHVKVWMSYVKFEMSHSQEEGIEPISLARRIYERGNTALRESGEKEERLLLLEAWREMEKVHGDEESYKKVEAKLPRRVRRRQAVIAADGSEEGWEEVYDYIFPEDEAVKPNLKLLEKAKAWKKKQEADNQTNDED

SEQ ID NO: 12574 - protein, 476 aa, Piezodorus guildinii; identical to SEQ ID NO: 12348

SEQ ID NO: 12575 - protein, 173 aa, Piezodorus guildinii
MCELNVLASVSPSIVTPSVELSTYRDRRFSGTKSEQEETLLHSSTLYVGNLSFYTTEEQIFELFSKCGDVKKIVMGLHKFKKIPCGFCFVEYYERQSAEGAMRYVNGTRLDDRIVRTDWDAGFVEGRQFGRGRSGGQVRDEFRRDYDAGRGGYGKMVQEVSSKAEVATIFAGQ

SEQ ID NO: 12576 - protein, 320 aa, Piezodorus guildinii
FFFLSTPSKMAAAIGRVYGSRLLKINPVSKHFQIGSFSTTKSWSRGKKALYTSLGILTGGTGMLIYALEKSLQAGDLELHPPKLPWNHSGYFQALDHASIRRGYEVYKNVCAACHSLRYVCYRDLVGVSHTEAEAKAEAEEQLVLDGPNELGEMFKRPGKLSDHMPSPYPNEEAARAANNGAYPPDLSYIVPGRHGEEDYIFHLLTGYCDAPAGLVLRDGQYFNPYFPGGAISMAQALYNEIIEYSDGTPATQSQLAKDVATFLKWTSEPEHDVRKQMALKVMFIFSIFIAATLYWKRHKWSTLKSRKIVFRPPSSPPKV

SEQ ID NO: 12577 - protein, 575 aa, Piezodorus guildinii
MLALQQYGESDSDKDEEEKKEEVDKDALLHLTPLSTGQSSIIQTAICPAPAALPPVEYNPLKFIKPGCTEMTVNLKYEELFAADVGPENPYLTDQQKAPKNILSGYVEAAHMSEFQFENQRKTFQSFGYALDPSIDNMGRSEDGIPVVGAVEVAKETNLKTVFESTSKRPLDRRKRNKNDDPSDINGFLGPWGSYVDEKKVVKPDPEVAAELEEYLAKRQKLGKKVEDKPLEEKTVLHIKDPVDYQGRNFLHPPQDVGVNLKSDSPPDKCFIPKSEIHVWKGHTKGISAIRWFPKYAHLLLSCSMDCRVKLWEVYNERRCIRTYYGHRQAVRDVCFNNRGTKFLSAAYDRYIKLWDTETGECISRFTSRKIPYCVKFNPDEDKQNLFVAGTSDKKIICWDLRSGEIVQEYDRHLGAVNSITFVDENRRFVTTSDDKSLRVWEWDIPVDMKYIADPSMHSMPAVTPSPNQKWLACQSMDNKIVIFSALNRFKLNRKKTFTGHMVAGYACTLDFSPDMSYIVSGDADGKAYVWDWKTTKLFKKWKAHDHVCIGVLWHPHEPSKVVTAGWDGLIKYWD

SEQ ID NO: 12578 - protein, 268 aa, Piezodorus guildinii
MVQKKPKKKTGKKVAAAPLAVKKQEVQKVVNPLFEKRPRNFGIGQDIQPSRDLSRFVRWPKYIRIQRQKSVLQKRLKIPPSIHQFSQSLDKQTATQLFKILEKHRPETALAKKQRLKARAEGKIKQKEEVPTKKTNVIRSGVNTVTRLVEQKKALLVVIAHDVDPIELVLFLPALCRKMNVPYCIIKGKARLGRLVRRKTCSSIAVTQMEGNDRTALNKVIEAVRTNYNDRYEEIKRHWGGGLLGSKSAARIAKLEKAKARELAQKQG

SEQ ID NO: 12579 - protein, 334 aa, Piezodorus guildinii
MANMIKDVTIDDKMPNELLLDKHIKFVLAYGANKDEYEYCTTEHLRMSGMYWILTTLAVTKKLDEVDKKQFIDFILECTDEKTGGIGACVGHDPHILYTLSAVQIACILRSLDQLPLEKIVSFVSSLQKEDGSFMGDKWGEVDTRFSFCAVACLSLIGRLDAINLEKAVNFVLSCQNFDGGFGSQQNSESHAGLIYCCVGVLSITQNLYRIDADQLGWWLCERQLPSGGLNGRPEKLPDVCYSWWVLSSLTMLGRLHWIDKQLLKKYILASQDSEGGFSDRPGDMPDPFHTLFGIAALSLLGESDLMKINPTYCMPQYIIDELNLDPEIMQSQS

SEQ ID NO: 12580 - protein, 915 aa, Piezodorus guildinii
MMLKMNSEATAQLIQILEKTVSPDKNELEAAQNYLEHAAQTNLAEFLQTLSHILQHGGNSPVARMAASLQLKNNLTSKDPSIKAQYQARWLAFPEETRMYIKKNILGALGTENTRPSSAAQCVAYVAVAEIPVGQWPDLIPTLSANVTGPSSTEIMKEATLEAIGYICQEIEHDCLASQSNQILTAIVHGMRSAERSNYVRLAATTALLNSLEFTRANFQQDMERNYLMEVVCEATQSTDTQVRVAALQCLVKIMTLYYQYMETYMGQALFPITLEAMKSDIKEVALQGIEFWSNVSDEEVDLAIEESEAVEMGKPPARTSRYYAKGALQYLVPVVLTKLTKQEEFDDEDDWNPSKAAGVCLMLLATCCEEDIVPHVLPFVQQNIKSPDWRYRDAAVMAFGSILSGLHSNTLKPMVEQAMPTLIQLMYDSSVAVRDTAAWAFGRICEIVPEAATNENYIKPLLESLLNGLKAEPRVAANVCWAFTGLAEASYDQAENQVEDGSQPETYILSRYFEYIVHSLLATTDRVDGAQANLRPAAYEALMEMVKNSPKDCYTVVQRATLIILDRLNQVLAMEQQIQSHSDRAQFNDLQSLLCATLQSVLRKMTPEDAPQISDTIMNALLQMFNSNSCKSGSVQEDAIMAVSTLVEVLGDGFIKYMPAFQPFLCMGLKNHAEYQVCCAAVGLTGDICRALKNKVLPYCDDIMRLLLENLSDNSVHRSVKPQILSTFGDVALSIGADFKKYLDVVLHTLMQASQAQVDTSDFDMVDWLNELREGIVEAYSGIIQGLKGEDNNTAASAANLALLEPHIPVMAQFLTCVSRDTSKQDKVLAGSAGLVGDLCSAFGAKVIPLLDIDPINELLTQGRRSRINKTKAVSNWASKEMRRYKATIANAASCGSEVVTNGAQAMMSPPGAM

SEQ ID NO: 12581 - protein, 501 aa, Piezodorus guildinii
METILEQQRRYHEERERLMDAMVKEMLHKKSSYREQINSDHRLKMLLDQYMESTHKLKELYEDKDGIRKDEVAALSGPNEFSEFYSRLKTIKEFYRRIPNEISVPMSVEFEELAKLRENPTEETSNLVEFTDEEGYGKYLDLHECYEKYINLKGVEKVDYITYLTTFDRLYEIPKDRKSSEYKRYVIMLLNYLCDYIARIKPLLDLDQELTNVQKDFTSQWEAGTFPGWPKETGSVLSNVGAHLDLSAFSSPEELASLGLDRLKSALMALGLKCGGTLEERAQRLFSTKGKKSLDPNLLAKSKPGKSNRERDLERQRDIAFLEAQVYKLAELLSEQRAATKENVQRKQARTGEERGDSEGEASSSGSESEGEDDGVPYNPKNLPLGWDGKPIPYWLYKLHGLNISYNCEICGNFIYKGPKAFQRHFAEWRHAHGMRCLGIPNTAHFANVTQIEDALALWEKLKTMKHDERWQPEHEEEYEDSLGNVVNRKTYQDLKRQGLL

SEQ ID NO: 12582 - protein, 211 aa, Piezodorus guildinii; identical to SEQ ID NO: 12469

SEQ ID NO: 12583 - protein, 416 aa, Piezodorus guildinii
MQASLSSNQLVGIAVALSTIPNEKRRRKRKIWAKDLFLQRPRVRETGISEVLESDDFKLMRITPDAFYKLLKMVRPLIKKNNTVMREAVTEEERLIITLRHLATGKSYADLQNSTAVSPSLMTSVIRETCDAIYLSLKSGIKMPTTEQQWLEVADGFEKKWNFPHCLGSFDGIHVAINKPAHSGAIFLNYKGYPSVVLLALVDANYQFMYLNTGANGSASGSTVFENTIFYQKYLSGKLNLPKDSPLPGMEEKVPYVFLGDCAFSLDENCMNTFPVKNIDHPKRIFNYRLSRVRNLAENTLGILTSRFRVLRQISSVKLDTIDSIVLACCSLHNYLSKNNPSYLDDGVTVDYEDLQNIEFRPGEWRLDNKLVPLCHKSIRNRFQEGDDVRQIFVDYFNSVGSVPFQEDMLKVIPEG

SEQ ID NO: 12584 - protein, 569 aa, Leptinotarsa decemlineata
MKKEAKERSRKERMGWDNEYLHYTNSDNPFGDGNLLSTFVWNKKLSKEGLIGVSHEEIEARNRFKQEENKRELEKVKKRRQERELERQKREEETQLLQRSKEAAQFEEWERHEDQFHLEQARLRSHIRIQDGRAKPIDLLAKYISAEEEVDAVEMHEPYTYLNGLHIKDLEDLVEDIKVYKELERGKNLDYWNDITVIVEDELQKLRKLEKQDDFDMGLNRREGIHQAVASDVTSIFKGKTAVQLAALEKQIEAKISSRADGIDIGYWESLLSQLKAHMARARLRDRHQDSLRRKLQVLKAEQAIIIPAQAEASSNEVDEPSTSKNFEPKPGVSQEDDRVSENEGNEDEAKDMLNEYFIAYQTGGYSPKFLSPEDIEPGTIVVTEEDDLKRLEFARLQVVGSGKKVENVITKEELLLQKEARKGMDADEAQFSVEQALDSQVYLWSDKYRPRKPRYFNRVHTGFEWNKYNQTHYDMDNPPPKIVQGYKFNIFYPDLIDKSSAPEYFLIPCLENKEFTILRFHAGPPYEDIAFKIVNREWEYSYKRGFRCQFHNNIFQLWFHFKRYRYRR

SEQ ID NO: 12585 - protein, 369 aa, Leptinotarsa decemlineata
MDNLEANIMDKSMRSVFVGNIPYEATEEKLKDIFGEVGQVLSFKLVFDRETGKPKGYGFCEYRDQETALSAMRNLNGYEIGGRNLRVDNACTEKSRMEMQNLLNQPPVENPYGEPIQAEKAPEAISKAVASLPPEQMFELMKQMKTTIQNNPTEARQMLLQNPQLAYALLQAQVVMKVIDPQTAASLLHPINQVPATLMPGDKNVPVQVPISNQYREPPAPVQPPRQEFQPVPAPVLHPSAQPSVFAGQDIDLRSIGGSTDLRMTRLGDQDMRQIPGPLQNPLPPPVAESFQRDLRDPRPIPQAFSVEPRQARIDPRQKPSAMPPVQLQPQPVRPPLQPQTTGPVPLRPPVPQPMANPVPATVSPGIGP

SEQ ID NO: 12586 - protein, 216 aa, Leptinotarsa decemlineata
GPPGTGKTLLARAVASQLDANFLKVVSSAIVDKYIGESARLIREMFNYAKDHQPCIIFMDEIDAIGGRRFSEGTSADREIQRTLMELLNQMDGFDSLGQVKMIMATNRPDTLDPALLRPGRLDRKIEIPLPNEQARLEILKIHALPIAKHGEIDYEAIVKLSDSFNGADLRNVCTEAGLFAIRAEREYVIQEDFMKAVRKVADNKKLESKLDYKPV

SEQ ID NO: 12587 - protein, 253 aa, Leptinotarsa decemlineata
DTRTTIFSPEGRLYQVEYAMEAISHAGTCLGILANDGILLAAERRNTNKLLDEVFASEKIYKLNEDMVCSVAGITSDANVLTNELRLIGQRYLFQYGESIPCEQLVSWLCDVKQAYTQYGGKRPFGVSILYMGWDKHYGYQLYQSDPSGNYSGWKATCIGNNSSAAISNLKQEYKEGEMTLKDAKSLAIKVLVKTLDMAKLTSEKVEMATLSRVNNKTVINILSSTEVENLISEFEKNEATLEATRKEQKQAV

SEQ ID NO: 12588 - protein, 881 aa, Leptinotarsa decemlineata
METSKIEVKTNDDKNKNELSDEDKLLQEELNLCVEKLQESDEKLYLPALHALGNNIRASTTSMTSVPKPLKFMKPHYETMKQAYEKVTNPEIKNVFADIISVLAMTMGEGRECLKYRLLSNLGNIGEWGHEYVRHLAGEIAGEWAETDFMVNTEIRDKLILLAKQILPYNMAHNAEAEACDLLMEIERLDLLEQYVDENNYQRCCLYLTSCIPYVADPENNTLLQTALLLFRKFKQYSQALRLAMQLNDHSLIEEIFTTCPDTAIQKQLAFMLGRQQIYIEIPESTPEYEDIIEIMANCHLNNHFLNLARELDIMDPKTPEDVYKSHLENSRPPFGGSQVDSARQNLAASFVNGFVNAAFGQDKLLMEDGNKWLYKNKEHGMLSATASLGLVLLWDVDGGLTPIDKYLYSSEDYIKSGALLACGIVNCGVRNECDPALALLSDYVLHNTNIMRIGAIVGLGLAYVGSNREAVLSLLTPVFSDPKSNMEVIGMSALACGMIAVGSGNPQVTTTIMQTLMEKSDTELKDTYARFLPLGLGLCHLGKQEGIDTIIATLEVIPEPFRSMATTMVDICAYAGTGNVLKVQNLLHICSEHYEGSDSTDKSSKDKDKKETVKEKDLSTRQAVAVLGIALISMGEDIGSEMAFRTFGHLLRYCEPAIRRAVPLALGLISVSNPKLGILDTLSKFSHDSDAEVAHNAIFAMGLVGAGTNNARLAAMLRQLAQFHAKDPNNLFMVRIAQGLTHLGKGTLTLSPYHSDRQLMSPVAVAGLMATLIGFLDVKNIILGRSHYLLYTLAAAMQPRMLVTFDEELNPLPIPVRVGLAVDVVGQAGKPKTITGFQTHTTPVLLAYGERAELATEEYVALTPIMEGFVILRKNPDFNP

SEQ ID NO: 12589 - protein, 414 aa, Leptinotarsa decemlineata
MDPAEEQEVKDVKPKADSDEDKNQQQPQQPQQQPQQRPPPSSTVIKRNFITTAGTIVENYDEQPPEAAGEEIVNTSTSTPQEQSPVTHKIESPESGSYQEIITQRDIKTYSVEVPDTYTASGTYSSELYSIDNSMTSVTISSDLEHQGDYTNLQTAQYNNGYTDASQYMEQHQYQTLYTERGAVDSSPPVLYRNDPNLGSSRYQGDYEPSTQTQVSLLNPSSETVYSTFPSTSSATYHQFYQNNPNVLHPADSTQAYGGAYVNTAWSSGGGLDDGHRASQEIGNRRNGVQCANCKTNTTTLWRRNNQGEPVCNACGLYFKLHNVNRPISMKKEGIQTRKRRPKNSSSVSSAGASNQVRLAPYMGYLQVSDELPQDQYQPPMNIYPTSNQPVYNQYTPAAIEQLRNLSAIQPIMV

SEQ ID NO: 12590 - protein, 1036 aa, Leptinotarsa decemlineata
GTEYFNQKPKKGIEFLQEHGFLKPVLDIEEIVMFLRENPGLSKAMIGEYISNRSNLKILEAFVKTFNFTDVRIDEALRAFLESFRLPGEAPTISLILEHFADHWHKSNGEPFADVDSAFTLAYAIIMLNVDQHNENAKKQTVPMSASAFKKNLKGVNGGDDFDEELLDEIYNTIKNDEIVMPAEQAGIIRDNYLWKLLLRKGQSKEASYVHENSGTYDFELFQILYGPAVSALSSGFEKSDNPSIYKKIMKGFEQCAFIASNLNIPKSLDMLLLTISKFSLFHNGGRQNNVVIQFGANNKAQLALKTFFALFHLHGNSITEGWKTLFDLMLSLYTNDLLSKTFTEIEDFIEPSGKFVLHFEEAPNLEKQDTGLLSSLYSYMVSAENLSKVPTPEEQYFIEITKECIKDCNLDQLITDSKFLHENALLEMVKTLIELSRGPDIQESLGYNYNQNVTVFFLELLIKIVMQNRDRVMSIWQNVRDHIYTIVMNASLFDYQFLLERSVIGLLRIAIRLMRNEEMSHIVLQSLRMLLLLKSSTLSRISRQISFGLFELLKTSAQNIHTNTDWTIIFTLLECVGAGAQPPKPISEDSSLLSHEIKSGEEYPDNTREDDAIVDRGYKSDSELTKSTKHDQEHQKSFVPVSPLGTPSTGGWILVGNEGEIQPVMGRTVPPTQYELCLEKNLGIHDPRSMMKCCESLAFLVRDVAHITPYNFDICVHCIRTFVEANVQSCNGTKRFANHESRPRIKSNRTRLRVSRNRKSPTSSPDEDEESEEEGVPSGYHQISIQLLDLMHTLHTRTAQIFKWWAEEGGEVSQETSLWSQGWCPLLQGIARLCCDSRYQVRTSAITYLQRALLVHDLQTLSGPEWEQCFQRVLFPLLNYLLQPTMPKDAGSMEETRMRAATLLSKVFLHHLTPLSSLSTFSNLWLIILDFMDKYMHADKSDLLYEAIPESLKNMLLVMDSAKVFDGPEGRSILWNATWERITKFLPELKNDLFREIESESQASVEDKLLENMRNTQQSFETKESTPYSEKLITC

SEQ ID NO: 12591 - protein, 135 aa, Leptinotarsa decemlineata
FSPYADNGGSVVAIAGDDFVVVGADTRLSAGFSIYTRDQNKLFPLSKTTVLGCSGCWCDTLTLTRILKSRMQMYEQEHNKVMSTTACAQMLSTMLYYKRFFPYYISNVLVGLDNEGKGCVYSYDPIGHCEKTTYR

SEQ ID NO: 12592 - protein, 935 aa, Leptinotarsa decemlineata
MDQKPGLDLVISAVSALYNNPERSEKERASQWLLELQKSVHAWTVADELLHLKRDLESCYFAAQTMRTKIHQSFHELPAEVHNSLRDSLLEHISQINEGTNAVIVTQLCVALADLALQMPSWQKPTLDLINKFSQTNIWPLLEILTVFPEELESRSVRLGENRRIEVLEDMRYCAPTVNEFLKHCSNLYGTEWQDQVQINVKILRCFNSWVSVGAIGLGDLADNVVINRAFEILNFKPQNDKYTPAGSFHEAATDCICTLLLCLEDNNNQMVLENYLFNNIINLEVAYHLSVANEDQGKSMDYCRLFTELAESFLEKIISNSSQKQTHYAIKILDLVLMCVGHHDYEVAEITFNLWYVLSEELYQKNNKELTELFRPYVERLITALCRHCQMEPDCEGLLEEGDEFKDFRLKVSDLIRDVVFIVGSSSCFRQMFINLQAPGVTWDSSEAALFVMQAVAKNVLPTDNEVIPNVVEAILNVPENTHIAVKYTSVLLLGELCEWIEKHPNTLDPILNFLVCCLPQAGIGAAAAVALQNICASCNDHMPRHVPILLQLLYQVDTFAITNNAVIGLLKGVASIVGRMPAVEMAPAMRELCFMQLKQIDQLIEQDVVPVRGTKTDPGLWLDRLSAILRYVNVNVSEGEIHPCKPVILEVWPQLSRAFNKYQSDIRIIEKCCRSVRFLLRCCSQQAKELLEDLVSQMVRIYSIHKHSCFLYVGSILADEYASDSECVRGLLDMLQAFLEPTFQLLQEENGLRHHPDTVDDFFRLCGRFMQRAPVDFLQCTALVHILQCALMASTLDHREANMSVMKFFYDLISQGQNGRTQPDFEKRKMLVTSILEEYGQQLTTNLIHSCVFYLHSYMLTEVADVFVQLLDFNREATSKWLVNGLDQLPKHSNGGIMAATPQQLNDIHMSITTSNTSRSVTHALKDLTRLYR

SEQ ID NO: 12593 - protein, 503 aa, Leptinotarsa decemlineata
MAQRFPGPGPTQGPGGIPPQRYQPPQNSGMRQYNQQNFPQRPGYNPPPPTMSSSGGTMIQRPTGSPYSPMRAGPMPQPSSSKRPATENRGPVPQKTDYPHTTPSSSKKKKKLADKILPQKVRDLVPESQAYMDLLAFERKLDSTIMRKRLDIQEALKRPMKQKRKLRIFISNTFYPAKEPQPDGPEGPCQEGSVASWELRVEGRLLDDSKNDPNKVKRKFSSFFKSLVIELDKDLYGPDNHLVEWHRTLTTQETDGFQVKRPGDKNVRCTILLLLDYQPLQFKLDPRLARLLGVHTQTRPVIISALWQYIKTHRLQDAHEREYIVCEKYLEQIFNCSRMKFAEIPQRLNPLLHPPDPIVINHVISVEGGAESKQTACYDIDVEVDDTLKNQMNNFLLSTASQQEIQGLDSKIHETVDTINQLKTNREFFLSFAKDPQQFIHKWIVSQTRDLKTMTDVVGNPEEERRSDFFHQPWAQEAVCRYFYTKVQQKRAELEQALGIRNN

SEQ ID NO: 12594 - protein, 144 aa, Leptinotarsa decemlineata
MPKVRRSKKAPPEGWELIEPTLDELEQKMREAETESHEGKRKNESLWPIFKIHHQKSRYIFDLFYRRKAISRELYEYCLMENIADKNLIAKWKKQGYESLCCLRCIQTRDTNFGTNCICRVPKAKLEEGRIVECVHCGCRGCSG

SEQ ID NO: 12595 - protein, 294 aa, Leptinotarsa decemlineata
MPAATLSSLQHPNNEDCGIRDVWAHNLEDEFRTIRQIVQKYQYVAMDTEFPGVVARPIGEFRSSADYQYQMLRCNVDLLRIIQLGLTFLDDNGKTPGGSYTTWQFNFKFNLQEDMYAQDSIDLLQNSGIQFKKHEDEGIEPLEFAELLMSSGIVLMENIKWLSFHSGYDFGYLIKLLTDNNLPQDENEFFDLLKLYFPTIYDVKYLMKSCKNLKGGLQEVAEQLELERIGPQHQAGSDSLLTGMAFFKMKEMFFEDTIDDSKFSGHLYGLGTSFAVNGTSNNYANDNGDTTNSS

SEQ ID NO: 12596 - protein, 403 aa, Leptinotarsa decemlineata
MAGATKRAASVFEDLSNVEFETSEDVEVIDKFKNMNLKEELLRGIFAYGFDKPSAIQQRAIKPIMKGRDVIAQAQSGTGKTATFSISILQSLDLTMRETQVLCLSPTRELAVQIQKVILALGDFMNVQCHACIGGTNLGEDIRKLDYGQHVVSGTPGRVYDMIRRRALRTRSVKMLVLDEADEMLNKGFKEQIYDVYRFLPPSTQVVLISATLPHEILEITSKFMTDPIRILVKRDELTLEGIKQFFVAVEREEWKFDTLCDLYDTLTITQAVIFCNTKRKVDWLTEKMRENNFTVSAMHGDMPQKERDNIMKEFRSGQSRVLITTDVWARGIDVQQVSLVINYDLPNNRELYIHRIGRSGRFGRKGVAINFVKSDDIRILRDIEQYYSTQIDEMPMNVADLI

SEQ ID NO: 12597 - protein, 534 aa, Leptinotarsa decemlineata
MTAPTAGGDSNRGRTLAYKDKSKPADVRTSNINAAKAVCDAIRTSLGPRGMDKMIQSGNGEVTITNDGATILKQINVIHPAAKMLVELSRAQDIEAGDGTTSVVVIAGALLDAAEKLLHRGIHPTAISESFQRAAVLALEILNEISTPVEITNREELIKSASTSLNSKVVSQQSSHLGPLAVDAVLRIVEPGREQACNLNDIKVIKQLGGTVEDTELVEGIVFPQRSSNVSGPKRIEKAKIGFIQFCISPPKTDMDHNVIVSDYAAMDRVLKEERAYILNIVKQIKKAGCNVLLIQKSILRDAVSDLALHFLDKIKCMVIKDIEREDVEFVCKSLGCRPIASLDHFVAENLVSADLVEELGAAGNRMVKITGAQNAGHTVTLLVRGSNKLVLEEADRSIHDALCVIRCLVRKQAVIAGGGAPEIEIALKLAAIANRLEGIDAICTRAYANALEIIPFTLAENAGLNPIQTVTELRNRHAKGEISAGINVRKGTISDILEENVVQPLLVSTSALSLATETVRSILKIDDIVNTIT

SEQ ID NO: 12598 - protein, 409 aa, Leptinotarsa decemlineata
MEAMEVVVPEKEEGSPSDAKQTLQDVDIEDLYTKYKKLQQMLEFLEVQEEYIKDEQRNLKKEYLHAQEEVKRIQSVPLVIGQFLEAVDQNTGIVGSTTGSNYFVRILSTIDRELLKPSASVALHKHSNALVDVLPPEADSSISMLQADEKPDVQYSDIGGMDMQKQEIREAVELPLTHFELYKQIGIDPPRGVLMYGPPGCGKTMLAKAVAHHTTAAFIRVVGSEFVQKYLGEGPRMVRDVFRLAKENSPAIIFIDEIDAIATKRFDAQTGADREVQRILLELLNQMDGFDQTTNVKVIMATNRADTLDPALLRPGRLDRKIEFPLPDRRQKRLIFSTITSKMNLSEEVDLEDYVARPDRISGADINAICQEAGMHAVRENRYIVLPKDFEKGYKNNIKKDESEHEFYK

SEQ ID NO: 12599 - protein, 162 aa, Leptinotarsa decemlineata
MPHIKLQSSDGETFEVDVEIAKCSVTIKTMLEDLGMDDEDEEVVPLPNVNSAILRKVIQWATYHKDDPPPPEDDENKEKRTDDISSWDADFLKVDQGTLFELILAANYLDIKGLLDVTCKTVANMIKGKAPEEIRKTFNIKNDFTASEEEQVRKENEWCEEK

SEQ ID NO: 12600 - protein, 345 aa, Leptinotarsa decemlineata
MKATNIAKPSKMLTQKIINSNESLDKTEKIKLKPSVMDDKASCKELDQWIEQLNDCKQLTENQVKTLCDKAKEILSKESNVQEVKCPVTVCGDVHGQFHDLMELFRIGGRSPDTNYLFMGDYVDRGYYSVETVTLLVALKVRYKERITILRGNHESRQITQVYGFYDECLRKYGNANVWKFFTDLFDYLPLTALVDSQIFCLHGGLSPSIDTLDHIRALDRLQEVPHEGPMCDLLWSDPDDRGGWGISPRGAGYTFGQDISETFNHSNGLTLVSRAHQLVMEGYNWCHDRNVVTIFSAPNYCYRCGNQAAIMELDDALKYSFLQFDPAPRRGEPHVTRRTPDYFL

SEQ ID NO: 12601 - protein, 118 aa, Leptinotarsa decemlineata
PDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQI

SEQ ID NO: 12602 - protein, 542 aa, Leptinotarsa decemlineata
MMQPQILILKEGTDSSQGKPQLISNVNACQNVVDAVRTTLGPRGMDKLIVQRNGKSTISNDGATILKLLDIVHPAAKTLVDIAKSQDAEVGDGTTSVVLLAGEFLKQIKQYVEEGVHPRIIIKAVRQSLQICLDKISELSVKVNKSSAEEFRSLLEKCAATAMSSKLINQQRAFFSKMVVDAVLLLDDLLPLNMIGIKKVQGGALEDSMLVAGVAFKKTFSYAGFEMQPKVYKNCKIALLNIELELKAERDNAEVRVDNVKEYQKIVDAEWNILYNKLQKIHESGANVVLSKLPIGDVATQFFADRDMFCAGRVQEDDLKRTLKACGGAVMTTVNDLNNSVLGKCDLFEEKQIGGERYNFFKGCPNAKTCTLILRGGAEQFLEETERSLHDAIMIVRRTIKNDAVVAGGGAIEMELSKILRDHSRTIAGKEQLLIGAIAKALEVIPRQLCDNAGFDATNILNKLRQKHAQGGCWFGVDVNNEDIADNFKNCIWEPAVIKINALTAASEATCLILSVDETIKNQKSGDGQMPQMGGRGMGRPM

SEQ ID NO: 12603 - protein, 2934 aa, Leptinotarsa decemlineata
IFAHLRKVRSTKYPIQRCLRLVEAISRDLGTQLLKVLGTRRLMHIPFDDFEKVMTQCFEVFSIWEDEYEKLQALLRDIMKKKRDEHMKMVWRISPQHKKLQNRMDQMRKFRRQHEQLRTVIVRVLRPTIREIVAPIEGEDLEPPKATFSLDAADANAIEEVNLAYENVKEVDCLDISKEGQDAWDAAVQRYEERIDRVETRITAHLRDQLGTAKNANEMFRIFSRFNALFVRPHIRGAIREYQTHLIQRVKDDIEALHEKFKVQYPQSNSAKISKVRDLPPVAGSIVWAKQIDHQLTTYLRRVEDVLGKGWENHIEGQKLKADGDSFRLKLNTQEIFDEWARTVQQRNLGVSGRIFTIEAVRSKSGRGNVLKLKVNFLPEIITLAKEVRNLKCLGFRVPLAIVNKAHQANQLYPFAISLIESVRTYEMTLEKIEDKASIIPLVAGMRKEVQTLIAEGIQLVWESYKLDPYVQRLSDNIVSFQERVEELVIVGEQLEVDVRSLETCPYSANTFVDILSKIQHAVDDLSLKQYSNLHIWVSRLDEEVEKNLARRLQAGIEAWTDALSGQKKDIDHSMDTDAPVQPTHKPGGDPQIQIVIHEVRITNQTMYLYPSIEEARFQIMQQLFAWQAIVTSQQRLQSSRYQVGVDKPVTETYRNILTKLPGGPQPLNNAYSAIASKIKEVQKYVNEWLTYQSLWDLQAENLYGKLGEDISKWMECLNDIKKTRTTFDTSDTRREFGPIVIDFAKVQSKVSLKYDSWHKETLSKFGGLLSNEMTTFHANVSKSRSDLELQSIEAASTSDAVSFITYVQQLKRSMKAWEKQVEIYREGQRILERQRFQFPTNWLHVENLEGEWGAFNEIIKRKDSSIQTQVASLQQKIVAEDKAVETRTNDFLVDWERSKPVEGHLRPDEALSQLQLFESKFARLKEERDNVAKAKEALELQDPGGINSSEDRMQVVYEELQDLRGVWSELSKIWQQIDETREKPWLSVQPRKLRQQLDGMSAQLKGLPARLRQYSSYEYVKKTLQTYTKVNMMIVELKSDALKERHWKQLMKQLRVNWVLSDLTLGQVWDVNLQKNESIVKDIILIAQGEMALEEFLKQVRESWQTYELDLINYQSKCKLIRGWDDLFNKVKEHINSVAAMKLSPYYKVFEEEALTWEEKLNRINALFDVWIDVQRRWVYLEGIFSGSADIKTLLPVETSRFQSISSEFLGLMKKVSKSPMVMDVLNIPGVQRALERLADLLGKIQKALGEYLERERTSFPRFYFVGDEDLLEIIGNSKNIARLQKHFKKMFAGVASILLNEDNTVITGIASREGEEVVFGKPVSTVEHPKINEWLTLVEKEMRVTLASNLTEAVQDIKQFKDGIDPKLYMQWVDKYQAQIVVLAAQIFWSEDVEAALVKMNSEPQKGPLEKVLQQVENTLNVLADSVLQEQPQLRRKKLEHLINEFVHKRTVTRRLISNGVCSNKAFEWLCEMRFYFDPRQTEVLKQLTIHMANARFYYGFEYLGVQDRLVQTPLTDRCYLTMTQALEARLGGSPFGPAGTGKTESVKALGNQLGRFVLVFNCDETFDFQAMGRIFVGLCQVGAWGCFDEFNRLEERMLSAVSQQVQTIQEALKSQKEAAADGAASVGSISVELVGKQVKVSPDIAIFITMNPGYAGRSNLPDNLKKLFRSLAMTTPDRQLIAEVMLFSQGFRQAEKLASKIVPFFRLCDEQLSNQSHYDFGLRALKSVLISAGNVKRDRIQRIKETKTQRGETNIDEASIAENLPEQEILIQSVCETMVPKLVAEDIPLLFSLLNDVFPNVQYTRAEMKGLKDEIRKVCAEEFLVCGEGDEQGSAWMEKVLQLYQISNLNHGLMMVGPSGSGKSTAWRVLLKALERYEGVEGVAHVIDPKAISKEALYGVLDPNTREWTDGLFTHILRKIIDNVRGEINKRQWIIFDGDVDPEWVENLNSVLDDNKLLTLPNGERLSLPPNVRVMFEVQDLKYATLATVSRCGMVWFSEDVLSTEMIFENYILSLKNIPLEEGEDDSFGKTSESKDDVLSPTLQVQVDVANLLQPYLAPDGLVVRCLEYAMEQEHIMDFTRLRALSSLFSMLNQAIRNVLQYNHSHSDFPLSNDSLEKYIPRCLVYSVLWSFAGDAKLKVRSELGDFIRSVTTVPLPPDNNMPIIDYEVTIEGDWSPWSHKVPQIEVETHKVASPDIVVPTLDTVRHESLLYTWLAEHKPLVLCGPPGSGKTMTLFSALRALPDMEVVGLNFSSATTPELLLKTFDHYCEYRKTPNGVVLAPIQLGKWLVLFCDEINLPDMDNYGTQRVIMFLRQIVEQKGFYRASDQSWVALERIQFVGACNPPTDPGRKPLSHRFLRHVPVIYVDYPGETSLKQIYGTFTRAMLRLAPGLKGYAEPLTNAMVEFYLASQDRFTQDMQPHYVYSPREMTRWVRGICEAIRPLDNLAVEGLVRLWAHEALRLFQDRLVEDVERRWTNENIDAVALKHFPSANCEKALERPILYSNWLSKDYMPVEREQLREYVKARLKVFYEEELDVPLVLFDEVLDHVLRIDRIFRQPQGHLLLIGVSGAGKTTLSRFVAWMNGLSIFQIKVHNKYTAEDFDEDLRSVLRRSGCKDEKIAFILDESNMLDSSFLERMNTLLANGEVPGLFEGDEYTTLMTQCKEGAQREGLMLDSNDELYKWFTQQVMRNLHVVFTMNPSTDGLKDRAATSPALFNRCVLNWFGDWSDGALFQVGKEFTNRLDLDKPHWKCPDFFPAACTLIPTTPNHREAVINACVYVHQTLHKANSRLVKRGSRTMAITPRHYLDFIHHFVKLHNEKRSDLEEQQLHLNVGLSKIAETVEQVEEMQKSLAVKSQELQAKNEAANAKLKQMVKDQQEAEKKKVQSQEIQQQLAEQTVHIEQKRSEVMADLEQVEPAVIDAQTAVKSIKK

SEQ ID NO: 12604 - protein, 879 aa, Leptinotarsa decemlineata
MSKQKLMKDHKLDETNMADNVEEARRKDLEERDEFAHRLKKRDENRTRNIAHPSGSKAYEEAAKRLKLENADRGEIIPKLRVQSRRKYLEKRKEDKLQELEADIADDEYLFEEEILTERERKERYHKKELLKLAKEHEKARELERVHRYHMPRDLGKDSVSDYIEVDELEKVPQSEQKKWEKDQMASAVFKFGAKDSVRTDEYELLLEDQIHFIQALQIPGVTEKKETKLTEVQKKKLSIEETKKSLPIYPFKDDLIQAIREHQILIIEGETGSGKTTQIPQYLHEAGFTKNNKKIGCTQPRRVAAMSVAARVAQEMGVKLGNEVGYAIRFEDCTSSRTVIKYMTDGTLHREFLSEPDLQSYSVMIIDEAHERTLHTDILFGLVKDIARFRPDLKLLISSATLDVAKFSEFFDDAPMFQIPGRRFPVDIYYTKAPEADYVDACVISVLQIHVTQPLGDVLVFLTGQDEIESCQELLQDRVRRLGSKVKEMIILPVYANLPSDMQAKIFEPTPPGSRKVILATNIAETSLTIDNIIYVIDPGFAKQNHFNSRTGMESLMVVPISKASANQRAGRAGRVAAGKCFRLYTAWSYKHELEDNTVPEIQRMNLGNAVLMLKALGINDLVHFDFLDPPPHETLVLALEQLYALGALNHHGELTKLGRRMAEFPVDPMMAKMLLASEKYKCSEEIVSIAAMLSVNGAIFYRPKDKIIHADTARKNFNHIGGDHLSLLNVYNQWRDSDYSTQWCYENFIQYRSMKRARDVREQLVGLMQRVEIEMVSNITETVNIRKAITAGYFYHIAKLSKAGNYKTVKHNQSVTIHPNSSLFEELPRWILYHELVFTTKEFMRQVIEIESKWLLEVAPHYYKQKELEETNLRRKV

SEQ ID NO: 12605 - protein, 268 aa, Leptinotarsa decemlineata
MKVEEVKSTVKTQRISAHSHIKGLGLDESGFAIQSAAGLVGQEQAREAAGVVVDMIKSKKMAGRAVLLAGPPGTGKTAIALAIAQELGNKVPFCPMVGSEVYSSEIKKTEVLMENFRRAIGLRIRETKEVYEGEVSELTPVETENPSGGYGKTVSHVIIGLRTAKGSKQLKLDPSIYEALQKEKVEVGDVIYIEATSGAVKRQGRSDAFATEFDLEAEEYVPLPKGDVHKKKEVVQDVTLHDLDAANAKPQGGQDVLSMMGQLLKPKK

SEQ ID NO: 12606 - protein, 735 aa, Leptinotarsa decemlineata
MTSIIKVHALSGAMDESPPCYILQVDEVRILLDCGWDEKFNMEFIKEIKRHVHTIDAVLLSYPDVTHLGALPYVVGKLGLNCPIYSTIPVYKMGQMFMYDLYQSQHNMKEFCIFSLDDVDATFEKIIQLKYNQTVPLKGKGYGLTVTPLPAGHMIGGTIWKIMKVGEEDIIYANDFNHKKERHLNGCELEKLQRPSLVIIDAFNATYQQARRRARDEKLMTNILQTLRNNGNVLIAVDTAGRVLELAHMLDQLWRNKESGLLAYSLALLTNVSYNVVEFAKSQIEWMSDKLMRSFEGARNNPFQFKHLQLCHTQGELSKVSSPKVVLASSADMESGYSRELFLQWCSNPANSVILTTRTSPGTLARDLVDNGGERTVDLTVEKRVRLEGAELEEYEKRQRERCEDDETKEEGDSDSDDDIEMSVISKGRHDIVIKQEGKISTGFFKVTKKMYPMYPFHEEKVKSDEYGEIIRPEDYKLADVPLEGEDNKENLVVKKEEEEITEIPEMPTKCIVLQRTVQVNCQVHYIDFEGRSDGESLMKILSHLKPRRVIVVRGTAENTAVIAKYCEENVQVARVLTPAKGEIVDATSETHIYQVRLTDALVSHLAFQKAKDAEVAWLNAQIVVRETQADAKRMNIDNEPMEIDDDDMRILTLEPASEEDNHEPVFINELKLAEFKQILARSNISSEFSGGVLWCSNGTIAIRRVDPGKIMLEGCISEDYYRVKELLYEQYAIL

SEQ ID NO: 12607 - protein, 759 aa, Leptinotarsa decemlineata
MPPLEVTPNSNNEEPGPINPVVGIIYPPPEVRNIVDKTASFVARNGPEFEARIRQNELGNPKFNFLNTGDPYHAYYQHKVKDFREGKGQEPAAGLNQAILKLSVTSAAQQKQQEILKQVEQPFVPKDPPPEFEFIADPPSISALDLDIVKLTAQFVARNGRAFLTQLMNREQRNFQFDFLRPQHSLFQYFTKLLEQYTKVLIPPKSMQQRLRDEAKSAKSVLEQVKYRAEWLKYQEAQKAKEEEILERERVAYAQIDWHDFVVVETVDYQPFEIGNFPPPTTPEEVGARILIQERIEDGEDIEMQLESDEEEPPPADEGLSTMQDKTHSRKGRDDNRIQDMEEESSEEEDESSLKPPPPPSIQPPLPPAPDKVLVKKYDPKQAVKVTRPTVGDDYLVSPITGEKIPASKVQEHMRIGLLDPRWVEQRDKQVMDKMNQETVYAAGSAIDASLKLLAERRTDIFGVGDEETAIGKKIGEEDVRKDEKVIWDGHTSSVETATRAARANITLEEQIHQIHKVKGLLPDEEKEKIGPKNIGSKSGKINIQSVITTKPPNQPPPPKPQVSLIQTQPAPPMAIPVPPQPTMMATQPPIMMMTAPPMPPMRPPPIMMAAPPPMASFVTPMPPPMGQPMGMPMKHPNDGMLDDEPSNKKLRNEDSLVPEEVFMTRNPGPVSIKVTIPLLPEKSEWKLTGQVMSLTLPLGESVANLKAKVQEETNMPPAKQKLFFDGMFFKDSNTLAYYNVTQGATIQLQVKERGGRKK

SEQ ID NO: 12608 - protein, 320 aa, Leptinotarsa decemlineata
MPSQEVSTTKVIVHPLVLLSVVDHFNRMGKIGNQKRVVGVLLGCWRAKGVLDVSNSFAVPFDEDDKDKSVWFLDHDYLENMYGMFKKVNARERVVGWYHTGPKLDQNDIAINELIRRYCPNSVLVIIDAKPKDLGLPTEAYQAVEEVHDDGSPTSKTFEHVPSEIGAEEAEEVGVEHLLRDIKDTTVGTLSQRITNQLLGLKGLHLQLREIRDYLIQVSENKLPINHQIIYQLQDIFNLLPDINQATFNSSFYIKNNDQMLVVYLAALVRSIVALHNLINNKLTNKDAEEGKKEEAKKDKENKEKEKEKDKDGKKDDKKK

SEQ ID NO: 12609 - protein, 532 aa, Leptinotarsa decemlineata
MFGGGRAPILVLSQNTKRESGRKVQVENINAGKQIADVIRTCLGPQAMLKMLMDPMGGIVMTNDGNAILREITVQHPAAKSMIEIARTQDEEVGDGTTSVIVLAGEMLAAAEQFLEQQMHPTIIIRQYRQALEDIVQLCEGPLSIAIERDDKAALANVVKGCVGTKFLSKWSDLAVNIALDAVNTVFLEENGRIEVDIKRYAKVEKIPGGSIEESRILKGVMVNKDVTHPKMRRYIKDPRIILLDCALEYKKGESQTNVEITSNMDFSRLLELEEEHVKRQCDDIIALKPDVVFTEKGVSDLAQHFLLKAGITAIRRVRKSDNNRIARACGATIVNRTEELQESDLGLGAGLFEIKKIGDEYFCFIVECKDPKACTILLRGASKDILNETERNLQDALQVARNIVLSPRLVPGGGAIEMAVAQRLLQKASHGPYRALAHALEIIPRTLAQNCGANTIRTLTTLRAKHANHTDLNKPCTWGIDGESGELVEMDKKELWEPLAVKLQTYKTAVETAILLLRIDAVVSGSKKKGD

SEQ ID NO: 12610 - protein, 135 aa, Leptinotarsa decemlineata; identical to SEQ ID NO: 12591

SEQ ID NO: 12611 - protein, 316 aa, Leptinotarsa decemlineata
MSRRAYRARRDRDRPAYNEFQFGFNMFPEIPRPFNITYQCFSVAMLPGNERQDVERGGKIIMPPSALEKLTRLNINYPMLFKLVNKKTNRVTHCGVLEFVADEGKVYLPLWMMHNLVLEEGDLVQMESVSLPVGTFSKFQPLNPDFLDITNPKAVLENCLRSFACLTTGDVIAVKYNQKAYELCVLETKPGDAISIIECDMNVEFAAPVGYKEPEQRKKEEEEAAVDPAELMPEPSGFVAFRGTGNRLDGKKRKDSTSSDFASAKPVYVRGIPDYDYQIGTLKFIRRPIKQKSDDIEESEEFKAFSGTGFSLRGRN

SEQ ID NO: 12612 - protein, 538 aa, Leptinotarsa decemlineata
MSSFPGSIAFDEYGRPFIIIRDQDQQKRLTGIDALKSHILAARQIANTISTSLGPKGLDKLMVSPDGEVTVTNDGATILKMMDVEHEVAKLLVELSQSQDDEIGDGTTGVVVLAGALLEQAGSLLDRGIHPIRIADGFELACQTAVQHLEKIAEVFPVSAENTDPLIKVAMTTLGSKIINKCHRQMAEIAVNAVLAVADLKTKDVNFELIKMEGKVGGKLEDSTLVKGVVIDKTMSHPQMPKELKNVKLAILTCPFEPPKPKTKHKLDVTNVDEYKELRQYEQDKFKEIVGLVKNVGATLAICQWGFDDEANHLLLQQELPAVRWVGGPEIELIAIATGGRIVPRFEELSPEKLGTAGLVREISFGTTKDRMLVIEECSNSRAVTILVRGGNQMLVAEAKRSLHDALCVVRSLVQEPRVVYGGGAAEISCSLAVSAQADQLATLEQYAFRAFAEALESIPLALAENSGLSSVHVLGELKAKQSAAEDPALGVDCMDTGNINMREQHVIESLRSKRQQLLLATQLVKMILKIDDVRQPN

SEQ ID NO: 12613 - protein, 113 aa, Leptinotarsa decemlineata
MASAMDVDAEEVEMPTSSSSKGEKKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 12614 - protein, 534 aa, Leptinotarsa decemlineata
MVSLNPVRILKNEAEEDKAEIARLSSFIGAITMGDLVKSTLGPKGMDKILVSSGRNAGSVEVTNDGATILKSVGVDNPAAKILVDMSKVQDDEVGDGTTSVTVLAAELLREAERLIEQKIHPQTIIAGWRKAVDVARKALRDASMDNSDNLEKFREDLLNIARTTLSSKILSQHKEHFAKLSVDAVLRLKGSGDLQAIQLIKKTGGTLEDSFLDEGFLLDKKPGVHQPKTVENAKILIANTPMDSDKIKVFGSHIKVDSMAKIAELESAEKEKMKDKVNKILKHNANVFINRQLIYNYPEQLFADAGVMAIEHADFDGIERLALVTGGEIVSTFDHPELVKLGTCDLIEQIMIGEDILLRFSGVALGEACTIVIRGATQQIIDEADRSLHDALCVLAATVKESRIVFGGGCSETLMSTAVSRAAANTPGKEAVAMEAFARALLQLPTIIADNAGYDSAQLVSELRAAHNAGKSTLGLDMERGEVGDMSVLGITESFVVKRQVLVSASEAAEMILRVDNIIKAAPRKRTEDRGMC

SEQ ID NO: 12615 - protein, 281 aa, Leptinotarsa decemlineata
MFRNQYDSDVTVWSPQGRLHQVEYAMEAVNLGSATVGLKSKTHAVLIALKRASSELSAYQKKIINIDEHIGITISGLTADARILSRYMRNECLNYKYSLDAHMPLNRLISTLGNKMQHCTQRYDRRPFGVGLLVAGYDESGSHIYQTCPSANFYDCKAMSIGARSQSARTYLEKHLDELPSCSLEQLVKHGLRALRDTLPPEVDLTTKNVAIGYVGKGQPFQILEENETAPYLALIEGEERRGGGAGGAGVEAQQADPLREDTGDEGPRDPVPTTAMDTTD

SEQ ID NO: 12616 - protein, 833 aa, Leptinotarsa decemlineata
MVQQSEHIEIKFSDDDLPYEEEILRNPYSVKHWLRYVEHKKAAPKGVNIVYERALRQLPGSYKVWYKYLRTRRMQVKSRCIIDPEYEEVNNAFERALVFMHKMPRIWMDYCTFLTDQCKITRTRNVFDRALRALPVTQHNRIWPLYLKFVKQHDIPETAVRVFRRYWKLCPENAEEYVDYLTEIGRLDEAAQVLAKIVNDENFASQKGKSKHQLWNELCELISKNPDKIRSLNVDAIIRGGLRRYTDQLGHLWNSLANYYVRSGLFERARDIYEEAIQTVTTVRDFTQVFDSYAQFEELSLSKKMEEVANQANPTEDDDTDLEMRLSRFENLMERRLLLLNSVLLRQNPHNVQEWHKRVQLYEDKPLEIINTYTEAVQTVDPKLAVGKLHTLWVDFAKFYEKNGQIDDARLIFEKATQVPYVKVDDLANVWCEWAEMEIRNENYDEALQLMHRATVMPSRKVAYHDDSETVQSRVYKSLKVWSMYADLEESFGTFKSCKAIYDRIIDLKIATPQIIINYGLFLEENNYFEEAFRAYEKGISLFKWPNVYDIWNTYLTKFLKRYGGTKLERARDLFEQCLEGCPPQFAKHLYLLYAKLEEEHGMARHAMAVYERSTKAVPEGEMFEIFNIYIKRAAEIYGIPKTRQIYEKAIEVLPEDKTRDMCIRFADMETKLGEIDRARAIYAHCSQICDPRITNEFWQIWKEFEVRHGNEDTMREMLRIKRSVQAMFNTQVNMMSAQMLSTAASMSGTVADLAPGVKDGMRLLEAKAVEMSGINFVRGETQGDKKDKVVNPDEIDIDDEDEEEEIPVEKQSIPSEVFGSLRVQVPVEEDDQ

SEQ ID NO: 12617 - protein, 394 aa, Leptinotarsa decemlineata
MANGPIAERNRDATIYVGGLDDKVSESLLWELFVQAGPLVNVHMPKDRVTMMHQGYGFVEFMGEEDADYAIKIMNMIKLYGKPIRVNKASAHQKNLDVGANIFIGNLDPEVDEKLLYDTFSAFGVILQTPKIMRDPETGNSKGFAFINFASFEASDASIEAMNGQYLCNRPISVSYAFKKDSKGERHGSAAERLLAAQNPLSQADRPHQLFADAPPIGMMPMTIAPPPPPVILTGMMPPPTPANMHPPPPPPVPPPSGFPSGIPPPPLPPSQPPLPPGAPPPPPISASTGSTPRPPLPPNPTSAPGGPPPPPRLIPPPWPGAGAGVIPPPPPGPPGSVSSTAATPFAGMFPPPPPPGGRPPPPNWRPPPPPSFPAGRPPFPPRGPPPPPATFES

SEQ ID NO: 12618 - protein, 257 aa, Leptinotarsa decemlineata
MGRVIRAQRKGAGSVFKSHTKRRKGAPKLRYLDFSERHGYIKGVVKEIMHDPGRGAPLAMVHFRDPYKFQTRKELFIAPEGMYTGQFLYCGKKASLQIGNVLPVGTMPEGTIVCNLEEKTGDRGRLARASGNYATVIAHNHDTKKTRVKLPSGAKKVIPSNNRAMVGIVAGGGRIDKPILKAGRAYHKYKVKRNCWPKVRGVAMNPVEHPHGGGNHQHIGKASTVKRGTSAGRKVGLIAARRTGRIRGGKVDAKKED

SEQ ID NO: 12619 - protein, 136 aa, Leptinotarsa decemlineata [sequence omitted]

SEQ ID NO: 12620 - protein, 530 aa, Leptinotarsa decemlineata
MAISLLNPKAEVARAAQALAVNISAAKGIQDVMKTNLGPKGTVKMLVSGAGDIKITKDGNVLLHEMQIQHPTASLIARASTAQDDMTGDGTTSTILVIGELLKQADIYVAEGLHPRILTEGFDKARAKALEVLEKIKIPVEINKESLTDVCRTSLRTKVHQKLADVLTDVCVDAVLAIKQGDKPVDLHMVELMEMQHKTETDTQLVKGLVLDHGARHPDMPKSLKNCYILTCNVSMEYEKSEVNSGFFYKTAEEREKMVSAERGFIEQRVKKVIALKKSVCDGTNKTFVVINQKGIDPMSLDMLAKEGIIALRRAKRRNMERLALACGGIAMNSFDDLQESHLGQAGHVYEHVLGENKYTFIEDCKVPQSVTILMKGPNKHTLVQIKDSVRDGLRAINNAIEDKAVIPGAGAFEITANKELLAFKDTVKGKVRLGIAAYAEALLVIPKTLAVNSGFDAQDTIVKLQEESRLNPEPVGLDLTSGEPINPKDAGIFDNYVVKKQIINSCSVIASNLLLVDEIMRAGMSSLKG

SEQ ID NO: 12621 - protein, 1048 aa, Leptinotarsa decemlineata
MDESSNRGLSRPMSSAAIAGSSVDPPAKKRKLETSTLEMANSSGPSRASEIDEGLYSRQLYVLGHDAMRRMAKSDVLISGLGGLGVEIAKNVILGGVKSVTLHDEVVCTISDLSSQFYISESDVGKNRAEACCKSLSELNNYVPTKAYTGPLDEQFIKNFSVVVLTTSSRSEQLRISEITHSNNIALIIADTRGLFAQVFCDFGESFTVVDTNGEPTVSAMIADISKDKEGVVTCIDDTRHGMEDGDYVTFSEVQGMTELNNCEPIKIKVLGPYTFSIGDTTSFGKYERGGNASQVKMPKELHFKPLKESLLAPEFVITDFAKIDSPQQLHLAFTTLHKYFEKNGRVPKPWSNEDADEFVSLAKSIAVDGSNDTEVNGSLLETFAKVAAGDLNPMNATIGGVVAQEVMKACSGKFHPIYQWLYFDSIECLPQDRSEITEELAAPFGSRYDGQIAVFGKEFQKKLAALKYFVVGAGAIGCELLKNFAMMGVGTEGQITVTDMDLIEKSNLNRQFLFRPHNVQQPKSATAAKVIKKMNPEVNVVAHENRVGPETESIYNDAFFEKLDGVANALDNVDARIYMDRRCVYYRKPLLESGTLGTKGNTQVIVPFLSESYSSSQDPPEKSIPICTLKNFPNAIEHTLQWARDNFEGLFRQNAENASQYLKDAGFIDRTLKLPGVQPLEVLESVKAALVDERPKSFEDCIAWARNHWQEQYSNQIRQLLFNFPPDQLTTTGQLFWSGPKRCPEALTFDINNPLHLDYVLAAANLKAQVYGIPTNRDRAYIAEVVSKVEVPEFVPKSGVKIAVTDSQMAMNGNNVDLDRVTQIKEELPSVEELNGLRLTPLEFEKDDDTNFHMDFIVAASNLRAANYKIPPADRHKSKLIAGKIIPAIATTTSVVGGLVCFELYKLTRSMKSLEPFKNGFVNLALPFFGFSEPIAAPKMEYCGNEWTLWDRFEVQGEMTLSEFLTYFKEKHNLEITMLSQGVCMLYSFFMAKAKAQERLGLTMSEVVKKVSKKKLEPHVRALVFELCCNDAEGEDVEVPYVKYNLC

SEQ ID NO: 12622 - protein, 263 aa, Leptinotarsa decemlineata
MADADDLLDYEDEENTEQTTTETTANEAQKKGVKGTYVSIHSSGFRDFLLKPEILRAIVDCGFEHPSEVQHECIPQAVIGMDILCQAKSGMGKTAVFVLATLQQLEPADNVVYVLVMCHTRELAFQISKEYERFSKYMPSVKVGVFFGGMPIANDEEVLKNKCPHIVVGTPGRILALVKSRKLVLKNLKHFILDECDKMLELLDMRRDVQEIYRNTPHTKQVMMFSATLSKEIRPVCKKFMQDVIENYLNTNLVPACYPRIVK

SEQ ID NO: 12623 - protein, 288 aa, Leptinotarsa decemlineata
MGLVETDVEMKNADSPPGLEAGDSKRDTDLQSVLEIREHARQIEKSVTSKENRFILRVLRCLPNTRRKLNGVVLRSLINQIYPVSEREALLNFTEEAVGDLDTTQARARSATKSPLPEVDTYINLLILVRLIDTNKLQEAERCSQALMNKITTQNRRTIDHIAAKCYFYHSRVAELSNKLDTIRAFLHSRLRTATLRNDFEGQAVLVNCLLRNYLHYSLYDQADKLVSKCVFPETASNNEWARFLYYLGRIKAARLEYSVAQKHLVQAMRKAPQNAAIGFRQTVQKLT

SEQ ID NO: 12624 - protein, 326 aa, Leptinotarsa decemlineata
MPGTKVDSKQRITVRNLRIREDTAKYLRNLDLGSAYYDPKTRSMRENPNPNKDDTYHGENFVRFSGDTQNHAKAQLFAWEAYEKGVDVHLLAEPTKLELLKKEYEKKKEQIKTKIQSNVLERYGGEEHLEEPPRSLLLAQTEDYIEYSRSGKIIKGAEKEVIKSKYEEDVYINNHTSVWGSYWRGGQWGYKCCHSFIKNSFCLGEAGRNSEIVKPHELPESRGDVNEDIPDDKKGNSDRDESSSSSSDEKSKKKKQKREKKKLKKMKKKLRQEKHITNKMEETEEIMDERKRPYNSMYEVKKPTEEEMEQYFKKRKRDEDPMNQFL

SEQ ID NO: 12625 - protein, 208 aa, Leptinotarsa decemlineata
MGISRDHWHKRRSTGGKRKPLRKKRKFELGRPAASTKLGPRRIHYVRTRGGNLKYRALRLDTGNFAWGSEGTARKTRIIDVVYNASNNELVRTKTLVKNAIVVVDATPFRMWYENHYILPLGRKKGAKLTAEEEALLAKKRSKKVQKKYETRQKTSKVEPAIEEQFTTGRLLACLASRPGQCGRADGYILEGKELEFYIRKIKSKKAK

SEQ ID NO: 12626 - protein, 311 aa, Leptinotarsa decemlineata
MDRLLRLGGGMPGLSQAPPPSDAPVVDTAEQVYISSLALLKMLKHGRAGVPMEVMGLMLGEFVDDYTVRVIDVFAMPQTGTGVSVEAVDPVFQAKMLDMLRQTGRPEMVVGWYHSHPGFGCWLSGVDINTQQSFEALSERAVAVVVDPIQSVKGKVVIDAFRLINPNMMVLGQEPRQTTSNLGHLQKPSVQALIHGLNRHYYSISINYRKNELEQKMLLNLHKKSWMDGLTLADYAENCSVNEKTVSDMLDLAKNYNKALEDEEKMTPEQLAIKNVGKQDPKRHLEEKVDVLMTNNIVQCLGAMLDTVAFE

SEQ ID NO: 12627 - protein, 404 aa, Leptinotarsa decemlineata
MTVINKMEIDGATKGEGFRSYYITKIEELQLIVAEKSQNLRRLQAQRNELNAKVRMLREELMLLQEQGSYVGEVVKPMDKKKVLVKVHPEGKFVVDIDKNIDINDVTPNCRVALRNESYTLHKILPNKVDPLVSLMMVEKVPDSTYEMVGGLDKQIKEIKEVIELPVKHPELFDALGIAQPKGVLLYGPPGTGKTLLARAVAHHTECTFIRVSGSELVQKFIGEGSRMVRELFVMAREHAPSIIFMDEIDSIGSSRIESGSGGDSEVQRTMLELLNQLDGFEATKNIKVIMATNRIDILDPALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 12628 - protein, 214 aa, Leptinotarsa decemlineata
FLLLVKSLVGVCLLKMVKLYCISILYKGPTSATWLKSAFELQTFNFFQRGSVQEFMTFFCKTIVERTIPASRQSVKEGEYLCNVYVRSDNLAGVVISDHEYPSRVSHTLITKLLDEFAERISPANWPNLQEKDVAFPQVTTYLAKYQNPREADALTKIQEDLDETKIILHNTIQAVLERGEKLDDLVSKSEGLSMQSKAFYKTAKKTNSCCTFS

SEQ ID NO: 12629 - protein, 267 aa, Leptinotarsa decemlineata
MFLTRSEYDRGVNTFSPEGRLFQVEYAIEAIKLGSTAIGICTSEGVVLAVEKRITSPLMEPTTIEKIVEVDKHIGCAVSGLMADSRTMIDRARVECQNHWFVYNENMSVESCAQGVSNLAIQFGDSDDDGAAMSRPFGVAILFAGIDEKGPQLYHMDPSGTFVQFDAKAIGSGSEGAQQSLQEVYHRSMTLEEAMTAALTILKQVMEEKLNASNVEVATMTSKDLFHMFTKEQVEEVLKCMERNEPEHHHIGGMEAASGKRNTPTMS

SEQ ID NO: 12630 - protein, 436 aa, Leptinotarsa decemlineata
IFKIISMMHFIHHHGKKEDNGSKEKKHECSSKKEEKDDTGLRRPSSEHEAVMAEYWLISAPGDKTCQQTWETMNNLTSKQNNLCTNYKFHIPDLKVGTLDQLVGLSDDLGKLDGFVEQVTRKVAQYLGEVLEDQRDKLQENLMANNTDLPNYLTRFQWDIAKYPIKQSLRNIADIISKQVGQIDADLKTKSSAYNNLKGSLQNLEKKQTGSLLSRNLADLVKKEHFILDSEYLQTLLVIVPKQQFSEWNATYEKITDMIVPRSTQLITQDNEYGLYTVTLFKKVVEEFKLHAREKKFIVRDFIYNEEELAAGKNEITKLVTDKKKQFGPLVRWLKVNFSECFCAWIHVKALRVFVESVLRYGLPVNFQAMLIHPNKKTMKRLRDVLNQLYGHLDSSAALSGPNFDSVDIPGLGFGQSEYYPYVYYKINVDMIEAKI

SEQ ID NO: 12631 - protein, 339 aa, Leptinotarsa decemlineata
MSILASPLSVAGSRTTGSSVRSQNVMAAATIANIVKSSLGPVGLDKMLVDDVGEVTVTNDGATILRLLEVEHPAARVLVELAQLQDEEVGDGTTSVVVIAAELLKNADELVKQKIHPTSIISGYRLACKEACRYIQDRLTIPVEDLGNDCIINVAKTSMSSKIIGADADLFSSIVVDAANAIKVTDSRGNAMYPIKAVNVLKAHGKSARESFLIQGYALNCTVASQAMPKKIVNAKLACLDFSLQKAKMKMGVQVLITDPDQLEGIRSRELDITKERIQKILSTGVNVVLVSGGIDDLCLKYFVESGAMAVRRVKKADLKRIAKATGAAFLTSLTNMDG

SEQ ID NO: 12632 - protein, 256 aa, Leptinotarsa decemlineata
MFSSLSDAPPLWNNGPAPGSFYNFPGHQVKPNDYFTHTQSPVTTATSIVAIAYDKGVLIAGDLLASYGSLARYRNCPRVIEVNSNIILGAGGDYADFQYVKSFIDQKIIDEECLDDGLKFKPKSMYCWLTRIMYQRRSKFDPFWNNLVIGGIQDGEPFLGTVDKLGTAYVDKAICTGYGAHIALPMLRDAMDKKPNLNQAEARALVEKCLEVLFYRDARSFPKYQLGIIDKDEGVKIEGPLSVKQNWSIGTIIKSV

SEQ ID NO: 12633 - protein, 485 aa, Leptinotarsa decemlineata
ILEKVEGCKELLEVPGRIFLYEGDLLEIDPTENTALKSVHVYLFTDGFMITNRNSNSRGLMKYIYEIIYDLSSLAVVNVRDLGNIKHAFKLLIFPDTRVFQCSSNSNKKEWLDKFDIAKKTRLAQEQQKRESVVEKSPSRSASMESPSFNPFDEVEEDTGLVHPEWFIDLPEELDVCVAQRHFEEALVLLQKAKDYINECLTTNDQLDHVMIDIQRKVEQRQNNLTEVFMKELEVNPDKSLQGGLRAARRAVRLLNQLGRSTQSCNLFLKLCSSMLKNQCKRVKREGSTATYVRHLSSVVFTNMCHMSEEFLRAFQDSPTCASAYVMWASSELSLFTTHFIKQVFMPQTSLSTIAECVVFIRTQCERLYSYGVDLCYQLDGSLMSSLTKALKDARDKLIDSVKLRAIDDKWIPINLHSKSALARCLQEHAQMGLHLESYITGDTWLQLTPSTLAFTKMFLLFLNDCLKLKTNELMFTIDEMLYSV

SEQ ID NO: 12634 - protein, 885 aa, Leptinotarsa decemlineata
MKYVCQMTGKDLNPHSHAPLKREDKDRNPDRPAYSSTSVLRLPVSIDEGEEDSRKRVTRISSPERWEINQMISSGCIDKSELPEFDEDTGLLPKDEDGGEADIEIELVEDEPPFLQGHGRAVHDLSPVRIVKNPDGSLAQAAMMQSALAKERREQKMLQREQEVDSQPSGKNKNWIDPLPEEESKATTVRGIGLQSQDLPEWKKHVIGGKKSSFGKKTNLSIIEQRQSLPIYKLKEELRKAVTDNQILIVIGETGSGKTTQITQYLAEAGLTARGKIGCTQPRRVAAMSVAKRVAEEFGCRLGQEVGYTIRFEDCTSPETMIKYMTDGMLLRECLMDLDLKQYSVIMLDEAHERTIHTDVLFGLLKQAVLKRKELKLIVTSATLDAVKFSEYFFKAPIFTIPGRTFPVEVLYTKEPETDYLDASLVTVMQIHLREPPGDILLFLTGQEEIDTACEILYERMKSLGPDVPDLIILPVYSALPSEMQTRIFEPAPPGSRKVVIATNIAETSLTIDGIFYVVDPGFVKQKVYNSKTGMDSLVVTPISQAQAKQRAGRAGRTGPGKCYRLYTERAYRDEMLPTPVPEIQRTNLTTTVLQLKTMGINDLLNFDFMDAPPVESLIMALEQLHSLSALDDEGLLTRLGRRMAEFPLEPNLSKMLIMSVDLLCSDEILTIVSMLSVQNVFYRPKDKQALADQKKAKFNQPEGDHLTLLAVYNSWKNNKFSNAWCYENFVQVRTLKRAQDVRKQLLGIMDRHKLDVVSAGRNTVRIQKAICSGFFRNASKKDPQEGYRTLVDGQVVYIHPSSALFNRQPEWVIYHELVQTTKEYMREVTTIDPKWLVEYAPAFFKFSDPTKLSKFKKNQRLEPLYNKYEEANAWRISRVRRRRN

SEQ ID NO: 12635 - protein, 414 aa, Leptinotarsa decemlineata
MVRRKKNVDDILARINFPLFTVQILSPRYVIVGGGGGIAKTGIANGFEIFELSHDGSKFIAEEVTRHETGGNVVMYCSTFTDNKRSYVVAGQEDHCQLYHVNSELVSEEVENIDHNSPETRQRKPQKTDRNKNLKKSLKFVMKPSDSIQTDFIGPEPLSRVARIHHNGKLMATGGTDGHIRLWKFPSLQPLTVLKAHEKEIDDIDFSQFGNFLITVAKDGLGILWDCIKGKEYSRLNWKQPEGSKYLYKRCRFGVIEGEDKKSALYTISNPTGVAKKQKSYLQQWLPEDGLLKKVAEFDECLSALAVRDDGRFVAVGTMFSGSVLIYASFSLQPMLNIVGAHSMFVTGLEFFPVLNESRTVCSVAEAAVLSISVDNHVCIHTLPYRRTMPLWVGILILIFTLFLSFTFCSYIGL

SEQ ID NO: 12636 - protein, 413 aa, Leptinotarsa decemlineata
MAGAMLFERAQSVPSQHDKLLNLKRNEDDDDQNIVNKEQDILNLGEKYKKEGKAKELAELIKATRPFLSIISKAKAAKLVRSLVDYFLDLEAGIGIEVQLCKECIEWAKEEKRTFLRQSLEARLIALYFDTGMYAEALILESTLLKELKKLDDKNLLVEVQLLESKTYHALSNLPKARAALTSARTTANSIYCPPKMQAALDLQSGVLHAADEKDFKTAYSYFYEAFEGFDSVESPKALTALKYMLLSKIMINSPEDVQQIVSGKLAIRYAGQDIEAMKAVARASHKRSLADFQLAVKQFKHELEDDVIVRAHLGTLYDNMLEQNLCRIIEPYSRVQVDYVAKTIKLPMLQVEKKLSQMILDAKFHGILDQGEGVLIVFEATPVDKTYEMALETIQSMSKVVDTLYQKAKKLS

SEQ ID NO: 12637 - protein, 587 aa, Leptinotarsa decemlineata
MASKSKKSSTPASTHQRPASPLSPTRHSRLQEKQDLQNLNDRLACYIDKVRYLEAENSRLTREIQTTQETVTREVSNIKSMYDHELSDARKLLDETHREKARLEIDVKRLLDENEELKADLAKKSKDLVLAENSARIYETRCNELQLKANQAAADAKKAATDARDLEKERDKLRKLLDEHRKQLEEESLARVEVENSNQSLREELSFKDQVYQQQLTETRTRRQVEISEIDGRLAEKYEAKLQDALQELRDQYESQMATNRHEIELLYEQKIKNLQAANDRHQSSAVGALDELRQVRTRIDTLTSRISDLENQNAGLSGRARDLEKLLENERLRHAEDLALLERELQRYRDEMQVQLQEYQDLMDIKVSLDLEIAAYRKLLESEEARLNITPHGTEREVSHHSVRSSSQRRTPVRAGAKRKRTLLEESQESSLSDYSVNSSSKGDIEVADVDPEGQYVKLHNKSNQEVALGGWHVVRRVGDNETQFKFHRSLKLEGNGFVTIWSSDLNKDHEPPNNLVMKGQKWIVGDNMTTTVLNNNGEEVAVSERVKRQLSSSLLRHREMAGGYLSEELHHQQGDPQGDEKCRIM

SEQ ID NO: 12638 - protein, 803 aa, Leptinotarsa decemlineata
MAEGKSPDDLATAILRKKDRPNRLLVEEAANDDNSVVALSQAKMDELQLFRGDTVLLKGKRRKETVCIVLSDESCSDEKIRMNRNVRNNLRVRLSDVVSIQPCPDVKYGKRIHVLPIDDTVEGLTGNLFEVYLKPYFLEAYRPIHKDDVFVVRGGMRAVEFKVVETDPAPYCIVAPDTVIHCDGDPIKREEEEEALNAVGYDDIGGCRKQLAQIKEMVELPLRHPSLFKAIGVKPPRGILLYGPPGTGKTLIARAVANETGAFFFLINGPEIMSKLAGESESNLRKAFEEADKNSPAIIFIDELDAIAPKREKTHGEVERRIVSQLLTLMDGMKKSSHVIVMAATNRPNSIDPALRRFGRFDREIDIGIPDATGRLEVLRIHTKNMKLADDVDLEQIAAETHGHVGADLASLCSESALQQIREKMDLIDLEDDQIDAEVLNSLAVTMENFRYAMTKSSPSALRETVVEVPNVSWEDIGGLENVKHELQELVQYPVEHPDKFLKFGMQPSRGVLFYGPPGCGKTLLAKAIANECQANFISVKGPELLTMWFGESEANVRDIFDKARSAAPCVLFFDELDSIAKSRGGNVGDAGGAADRVINQILTEMDGMGAKKNVFIIGATNRPDIIDPAILRPGRLDQLIYIPLPDEKSREAIFKSNLRKSPIAKDVDLGYIAKVTHGFSGADLTEICQRACKLAIRQSIESEIRRERERAMNPNIAMDLDEDDPVPEITRAHFEEAMRFARRSVSDNDIRKYEMFAQTLQQSRGFGTNFRFPTAAGGPAAPGGTGGDQANFQDDPEDDLYS

SEQ ID NO: 12639 - protein, 274 aa, Leptinotarsa decemlineata
MGDQFDCALDLMRRLPPQQIEKNLSDLIDLVPSLCEDLLSSVDQPLKIAKDKETGKDYLLCDYNRDGDSYRSPWSNTYYPPLDDGSMPSERLRKLELDANHAFDQYREMYFEGGVSSVYFWDLDHGFAGVILIKKTGDGSKKIKGCWDSLHVVEVQEKSSGRNSHYKMTSTAMLWLQTNKQGSGTMNLGGSLTRQIEQDATVNEINPHIANIGRMVEDMENKIRNTLNEIYFSKTKDIVNSLRSVQSLTESRQQQALREDLAAALQRRHNKSDN

SEQ ID NO: 12640 - protein, 812 aa, Leptinotarsa decemlineata
MERPPRNEPPVEPVNGIVQPAVQPPPDMPGRVTNQLQFLQKTVLKAVWKHQFAWPFQQPVDAKKLNLPDYHRIIKQPMDLGTIKKRLDNNYYLSGKECIQDFNTMFTNCYVYNKPGEDVVVMAQTLEKVFLTKVADMPKDEFVVETPTKGLKGKKGRTSTGPAGPVSSVGRGRPPATVSSTSATPVATTTGSSGLPLGTQAPATVPGSTATTTIAPATTNSSLPSQPPAQPSNFHGAPSIVNSLDSNVNPGVLPGSVVPPSQPAKVKKGVKRKADTTTPTATAYDYAPPLESKSAKISTRRESGRQIKKPVRPELDGHVPQPASQKLKEKLSESLKACNEILMELFSKKHANYAWPFYQPVDADLLGLHDYHDIIKRPMDFGTVKQKMDNREYRTPQDFAADVRLIFTNCYKYNPSDHDVVAMARKLQDVFEVKFAKIPDEPLNRIGGSAAVSTLAVKSESSSSGSSSESSSDTEDSEEEKRNKQLKLLEKELTAMQEKMKKLVEESTKKKKEKKKTKVKPKKPPAAALPNSSSSIGKPGAHGALNKPNSLADSVDDSIASVVSGADLKIAAEAHHPTANKSLNMHHNMAAGANASAQAKTPKSKGLRGNKPATTPSAPPKRVKANNKAGPGRKKSAAQPPPAQCESEEEDNAKPMSYDEKRQLSLDINKLPGDKLGRVVHIIQSREPSLRDSNPDEIEIDFETLKPSTLRELESYVASCLRKKPHKKVTGKSKDEQIAEKKQELEKRLIDVNDKIGNSKKAAKKEEASKSDPTGAGGPSGRMSSSSSSSDSDSSSSSLSSSSSDSSDSEAG

SEQ ID NO: 12641 - protein, 406 aa, Leptinotarsa decemlineata
MSLSTARPLISVYNEKSEVVKETSIALPAVFKAPIRPDVVNFVHQQVSMNHRQPYSVSDKAGHQTSAESWGTGRAVARIPRVRGGGTHRSGQGAFGNMCRGGRMFAPTKPWRRWHRRVNVNQRRYALASAVAASGVPALVMSKGHVVDQIPELPLVVSDKVQEMSKTKEAVQFLRRIKAWSDIQKVYKSQRFRAGKGKMRNRRRIQRKGPLVVYHKDQGLRRAFRNIPGIDLVSVEKLSLLKLAPGGHVGRFVIWTESAFQRLDKLFGSWKTPSLEKKGYNLPQPKMSNTDLSRLLKADEIKAVLRAPQKKVVRRVRRLNPLTNTRALLKLNPYAAVLKRQALLTAQKRKLQRDEQLAKKRGITLSADSAVIKSAALQKRRREQLLKVKKEGKAKPVKAKKSSGKK

SEQ ID NO: 12642 - protein, 1532 aa, Leptinotarsa decemlineata
MADFIDREAEESSEEEDLEPRDRKKAKKAKAVDSSDEEEEDDEDRLREELKDLIDDNPIEESDAESDASGSSRSQKRKKSDEEDLDDRLEDEDYDLLEENLGVKVVRRKFKRLRRFDDNESEGEEEQNADQDRDQIAMDIFSEDDDERRSERSHRAPEPEAFGDEEDEGEYSDADDFIVDDEGRPIAEKKRKKKPIFSDAALQEAQETFGVDFDYDEFSKYDQDEYDESEEDEEDEYEEDDEGERRRRSKKAAKKKPTKKSIFEVYEPSELKRGFFTDLDNEIRNTDIPERMQLRDVPVTSVPDDSSELDDEAEWIYKQAFCKPSVSNMDANLSPEARDKMKKGPQTIVKIRKALDFIRNQQLEVPFIAFYRKEYVQPELNINDLWKVYRFDAKWCQLKTRKENMLRLFEKMRSYQLDILMKDPDAPIPDNVRVMKDSDIEQLKNVQTPEELNDVHNHFILYYAADLPAMHAAWRIKDKEEKKRAKREARMKLIAESEEGADIPEEVEEVEDDEPEPETLKYANRSGSYSLCVKAGLDGLTKKFGLTPEHFAENLRDNYQRHEVDQEHVEPLEIAKEFISPKFSTVEEVLQAAKYMVALQIAREPLVRKCVRETFYERAKMNVVPTKKGQKEIDESHNCYSMKYVKNKPVRDLTGDQFLKLCLAEEEHLLTISINETIEGNTSGSYIDEVKQLYIKDEFSKNVQDWNALRMECVERALTKSVFPDLKAELKRVLLSEAKECVLRACCRKLYNWIKIAPYTITFSEEDEDDWDTSKGIRTMGLAYVPDYTVSAFACIAAPDGEITDYLRLPHMLKRKNSYRNEEKLLKESDLQAVKNFIYTKKPHVIAIGGESREALMIAEDLRGVINELVESDQFPQIKVEIVDNELAQVYANSNKGQADFRDYPELLRQAVSVARKMQDPLVEYSQLFNADQEILSLRFSPLQESLPKEELLEALCLEFVNRTNEVGVDVNLAVQQAHKSNLVQFICGLGPRKGQALLRVLKQTNQRLENRTQLVTSCHMGPKVFINCSGFIKIDTSSLGDSTEAYVEILDGSRVHPETYEWARKMAVDALEYDDDEGANPAGALEEILEAPERLKDLDLDAFAEELERQGFGNKSITLYDIRAELNCRYKDLRQPFRSANPEELFDILTKQTPETFYIGKMVTASVIGIARRKPKPDQLDQANPVRNDETGLWQCPFCLKNDFPELSDVWNHFDAGSCLGQATGVRLRLDNGVLGYIYIKNISDKPVSNPEERVKVGQLIHCRIQKIDVERFSVDCTSKSSDLLDKNHEWRPPRDPYYDQEQEDKDKGIEAERKKDLQRKTYVKRIIVHPAFHNISYAETEKCMANMDQGEVIIRPSSKGFDHLTITWKVADGIYQHIDVKEEGKANPFSLGKSLLIGKEEFEDLDEIIARHITPMASYARDLLYFRYHKDFEGGQKDKAEEFLIEEKKKNSSKIHYVISAAKNFPGKFLLSYLPRNKVIHEYVTVTPEGFRYRQQMFDSLNSLFKWFKEHFRDPPPGGLTPGTPRSSGR

SEQ ID NO: 12643 - protein, 804 aa, Leptinotarsa decemlineata
MEKKRPRKSRSRSLENGQGKKKSQDYDDLPKDYPRYYGEDRPNSDRYWNKYPRKDNIKVGQRYYEAGCEKKEKKREEKPAIDKEPEDKSVIKPRERKTVDLLTSRTGGAYIPPAKLRMMQESITDKSSAAYQRIAWEALKKSIHGYINKINTSNIGIIARELLHENIVRGRGLLCKSIIQAQAASPTFTNVYAALVAVINSKFPNIGELLLKRLVLQFKRGFKQNNKVICISATTFVAHLVNQKVAHEILALEILTLLVESPTDDSVEVAISFLKECGQKLTEVSSKGITAIFEMLRNILHEGKLEKRIQYMIEVMFQIRKDGFKDHAAVLEELDIVEEEDQFTHLITLEDVKQVDTEDILNVFKFDDKYEENEGKYKTLSKEILGSDSESGSGSEGSEDGSEDDEEDEEVKDQGKIIDNTETNLIVLRRTIYLTIQSSLDFEECAHKLLKMELKPGQEIELCHMFLDCCAEQRTYEKFYGLLAQRFCQINKIYIEPFQKIFKDTYATTHRLDANRLRNVSKFFAHLLFTDAISWEVLEIMKLNEEDTNSSSRIFIKILFQELAEYMGLGKLNTRLKDETLQEHFAGLFPRDSPKNTRFSINFFTSIGLGGLTDELREHLKNIPKNTRFSINFFTSIGLGGLTDELREHLKNIPKNTELNLAVGKESSSSSSSSSSSETSSEESSDESSSSEDEKQNRRGKVYKKKNEIERKGDHHSTKKKERYTSKDDHKQENERHNDSSDRRKKKDYERVKSRSEDNGHRLKNERRVFEKHTSEKRSQSKDHGKYEKSRRHKNKDDRERRNS

SEQ ID NO: 12644 - protein, 593 aa, Leptinotarsa decemlineata
MALKAQVGQKIMNEVIKHKPVKKNGPVAQQQSHGVEWRILVVDQLAMRMVSACCKMHDISAEGITLVEDINKKREPLTTMEAVYLITPSEKSVRALMNDFESPRYMYKAAHVFFTEACPDQLFNELCHHPIAKHIKTLKEINIAFIPSESQVFSLDSPDTFQCSYDPTFAAARNGNMERMAEQIATLCATLGEYPHVRYRSDWERNVELAQLIQQKLDAYKADEPTMGEGPEKARSQLIILDRGFDCVSPLLHELTFQAMAYDLLPIENDVYKYEASAGVLKEVLLDENDELWVELRHQHIAVVSQSVTKNLKKFTDSKRMTQSDKQSMKDLSTMIKKMPQYQKELSKYATHLHLAEDCMKAYQGYIDKLCKVEQDLAMGTDAEGEKIKDHMRNIVPILLDPKITNEYDKMRIIALYAMTKNGITEENLSKLATHAQIKDKQTIANLQYLGVNVINDGGKRNKGYTIPRKERITEQTYQMSRWTPVIKDLMEDCIEDKLDQKHFPYLVGRAQSTGYHAAPSSARYGQWHKDRGQQAVKNVPRLLVFVVGGISFSEIRCAYEVTNAQKNWEVIIGSSHILTPEGFLSDLATLAG

SEQ ID NO: 12645 - protein, 712 aa, Leptinotarsa decemlineata
MMQQYMKELEQEPFNAEEFVERLAWRTIAETKNDGEEEEFNPNLLHESFVLAIKDLTLLQDRQQKKCEKLEMAVREDEAMFFQEIYNLLEQNKQAIDTFQELDGKINHVATKVLHLGDQLDSVNGPRLRVVDAQRLMTHLNEFLTTGPPSSAIFTDPYLIDEAADMIQKLYMISQDLPSKFDSVKRKIERKYCDIEKSLIEEFVNAMANEDLDRMKEIASVLSQFKGYSQCIDAYIDQSQVGCLSTKDVFGHLLTLCKYNNDIIRRVFNNPEQVMAKFVLNIYQLKIVEYIDQRLGPNLGSYNYLQTLFELYSKTNQLSSNLSTFNLGNDKNYLTKLTTNIFNKYVNEYITIELKCLKERCSANLQKYYESKHHQKKQIQSGGFQDLRRDLQAVIGTRANINIAQIENYGGETFLSEEVAIMILQDTKQAFQRCQLLSKPKEKESNATQILDRLINSLLIEHVDYAVELGLQAVPVVEGAKSPPVLYFFNVVHQSNNITHLMEKQFTDLVVPLVENTPKYNDCIQKKKFVLEDIERKINTGLDRCLNAVATWAKLYLQSEQKKSDFKPETDDFDTVASPACKTVLNYVKRIIKEIKASLDGNNVTAVLQELGIRLHRVVYEHMLQFQYNTAGAMVAICDLNEYRSSTKTLGPLVTELFDTLHSLCNLLLVKPENLQQVCSEDTLAKLERPILHNFIQLRSDFKVQKQMILNF

SEQ ID NO: 12646 - protein, 155 aa, Leptinotarsa decemlineata
MDFQNRPGGKTGGGGVASWSETNRDRRERLRQLALETIDLQKDPYFMKNHLGSYECKLCLTLHNNEGSYLAHTQGKKHQANLARRAAKEAKDSPSLLQPEKPRVEPKKFVKIGRPGYRVTKQRDPENGQQSLLFQIDYPEINDMVLPRHRFMSAY

SEQ ID NO: 12647 - protein, 136 aa, Leptinotarsa decemlineata
MSIGVPIKVLHEAEGHIVTCETITGEVYRGKLIEAEDNMNCQMTQITVTYRDGRVAQLENVYIRGSKIRFLILPDMLKNAPMFKKQTKAGTAGRGKSAILRAQARGRGRGQQPQMRGGRGGTWQNQQGGAPTGRGR

SEQ ID NO: 12648 - protein, 490 aa, Leptinotarsa decemlineata
MLTDSFPLETKCVTFSLWSNFQPSVRILSTLKNPYSPTLVSCLCNNLFRWRNMASKLQKAPLLRLFMSRGFSQLAPVSGNPNYELKTTILSNKLTVVCADNESSLVRVSVIFRAGSRYESSDNLGVTHVLRTAAGLSTKNASQFAIIRNIQQVGANLTATSDRETISYTLEGTRQAVEKVLPFLTEVATQQIFKPWEVSDITSRLQLDIATRSLPLRAIDLLHNAAFRTGLGNSMFIPKSQIGKISSETLQHYVASNFLSGRAAVIGFGIDQSELIHYAQTLNIESGEGCNNSSSYKGGELRSNKGGDVAFVTVAGEGASLKDPKEALAFAILQKAIGVGPQVKWGNNNGIFSRVVGTGEHTSSAINVSYSDTGLFGILIGTPAKSAGKLVESAVKLLRSGSVSDEDVNRGKKQLKSSLLLEAESGADAVRDIASQSVLTGNPQTASQIVAAVDSICTSDVRDALRNAGRKITLASIGNLSNVPYLDELK

SEQ ID NO: 12649 - protein, 110 aa, Leptinotarsa decemlineata
MRRAHGGNYYQPLSQDSNEIEDENNRMTQELQEKIGVLKSLSIDIGNEVKYQDRLLGDVDDDMDRTSGFLGTTMKKVLRLSRGSHNYYILYMFLFSIIVFFILYLVIKFR

SEQ ID NO: 12650 - protein, 491 aa, Leptinotarsa decemlineata
MISSRQAAKEHVLAVSRDFVSQPRLTYKTVSGVNGPLVILEDVKFPKYNEIVQLKLADGTIRSGQVLEVSGSKAVVQVFEGTSGIDAKNTACEFTGDILRTPVSEDMLGRVFNGSGKPIDKGPPILAEDFLDIQGQPINPWSRIYPEEMIQTGITAIDVMNSIARGQKIPIFSAAGLPHNEIAAQICRQAGLVKIPGKSVLDDHEDNFAIVFAAMGVNMETARFFKQDFEENGSMENVCLFLNLANDPTIERIITPRLALTAAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHSDVSNQLYACYAIGKDVQAMKAVVGEEALTPDDLLYLEFLTKFEKNFISQGNYENRTVFESLDIGWQLLRIFPKEMLKRIPASVLAEFYPRDSRH

SEQ ID NO: 12651 - protein, 795 aa, Leptinotarsa decemlineata
MSYIQGNRPIYQGSGDLPMPSSKEQTLMWQQNSYMDDSGIHSAGATAVPSLTGKEEEDMDLFMDQGYQGFTQDQVDEMNNQLNQTRSQRVRAAMFPETLEEGQLRIEIPSTQFDPGHQTAVQRLAEPSQMLKHAVVNLINYQDDADLATRAIPELIKLLNDEDQVIVSQAAMMVHQLSKKEASRHAIMNSPQMVAALVRAISNSNDLETTKGAVGTLHKLSHHRQGLLAIFKSGGIPALVKLLSSPVESVLFYAITTLHNLLLHQDGSKMAVRLAGGLQKMVALLQRNNVKFLTIVTDCLQILAYGNQESKLIILASQGPIELVRIMRSYDYEKLLWTTSRVLKVLSVCSSNKPAVVEAGGMQALAMHLTNSSSRLVQNCLWTLRNLSDAATKVDGLESLLQSLVQVLASSDVNVVTCAAGILSNLTCNNQRNKVTVCQVGGVDALVRTIVSAGDREEITEPAVCALRHLTSRHVESEMAQNAVRLNYGVQVIVKLLNPPSRWPLVKAVIGLIRNLALCPANHAPLREHGAIHHLVQLLMRAFQDTQRRASVASGGSQQPGNYPDGVRMEEIVEGTVGALHILARESHNRAIIRGQMVIPIFVQLLFNDIENIQRVAAGVLCELAADKEGAEIIEQEGATAPLTELLHSRNEGVATYAAAVLFRMSEDKPQDYKKRLSMELTNSLFREENLWNPDLGMGPDLQDILSPDQAYDMYGQGPPSVHSSHGGRPYQQQGYDQIPLDMQGLEIGSHAGGSNYSTLDAMDVADADADLNFDQLPTPPQDNNQVAAWYDTDL

SEQ ID NO: 12652 - protein, 161 aa, Leptinotarsa decemlineata
MARNAEKAMTTLARWRAAQLGETEKHKKRRPYLASECKSLYACEKWRMQIIREIAKKVAQIQNAGLGEFRIRDLNDEINKLLREKHHWEDQIEELGGPDYQRVGPRMLDHEGKEVPGNRGYKYFGAAKELPGVRELFEQEPPPPPRKTTAELMKDIDADYY

SEQ ID NO: 12653 - protein, 215 aa, Leptinotarsa decemlineata
MATEQEMPTFKCVLVGDGGTGKTTFVKRHMTGEFEKRYVATLGVEVHPLVFHTNRGPIRFNVWDTAGQEKFGGLRDGYYIQGQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAMPALVPPEVQMDPQWQKQIENDLKEAQETALPEDDEEL

SEQ ID NO: 12654 - protein, 159 aa, Leptinotarsa decemlineata
MTSMETVGTLFIKLLKLVINIIVLILYRTGFQGEFLGVGGTWNLNEEKNPDAEIVASGVFVGYIIYNIVSMISFCFATLDHKYNFTDILMNIIGLLLWVAVGATAIHYWHGYLAEHKYTHVDSERSVGLAMGSLCVLNGAAYLIDSVLSIIFLVKTKMN

SEQ ID NO: 12655 - protein, 613 aa, Leptinotarsa decemlineata
EKLLHLAKLMPTQWRTIAPIIGRTAAQCLERYEFLLDQAQKKEEGEEVDDPRKLKPGEIDPNPETKPARPDPKDMDEDELEMLSEARARLANTQGKKAKRKAREKQLEEARRLAALQKRRELRAAGIEVTSRRKRKRGVDYNAEIPFEKRPAIGFYDTSNEELDPMAPDFSKMRQQHLDGELRSEIEEKERRKDKQKLKQRKENDFPQAMLENREPAKKRSKLVLPEPQISDQEMHQVVKLGKASEVAREVALESGVETTDTLLSDYTFTPQATATPRTPAPQTDRILQEAQNIMALTHVDTPLKGGLNTPLHNSDFSGALPQAQTVSTPNTVLATPFRSSRSDGSATPSSTVGFMTPRSGAVVPVGAQGAYVPSVRDKLNINPEDGTVDVTTTPATQKMYQNSVRSHVKVGLSSLPQPKNDYEIVVPEHEDQEMPEQAQEQLVEDQADIDKKIQEELKAKAARELASRSQVIQRGFPRPQEVNMSVLRPPHESYSLTDLQKSEELIKCEMVTMLLHDNLKNPVPNSNKRSNLSQAEQLAFLEQHPYENFRDEDIAIAKNMLKREMDIVKVGMSHGELPLDVYTQVWEECLGQVLFLPNQNRYTRANLASKKD

SEQ ID NO: 12656 - protein, 157 aa, Leptinotarsa decemlineata
MMQFMLLFSRQGKLRLQKWYVAHPDKLKKKITRELITTILARKPKMCSFLEWRDLKVVYKRYASLYFCCAIEQSDNELLTLEIIHRYVELLDKYFGSVCELDIIFNFEKAYFILDELLLGGEVQETSKKNVLKAIAAQDLLQEDEAVEGALRDIGLL

SEQ ID NO: 12657 - protein, 416 aa, Leptinotarsa decemlineata
MYRIHCVMRKYAFTNGLRLYSREPQKRSSFLSRLYDNFREEMAKNKEMKESLKKFREEAEKLEQSDALKAARQKFETVEKEASKGSEVFKDSLGTIKDRVKGVIDEASKSDIAKKAGKFTEEVGKQTHRISEKAQEISKTGAFQSISQATQAVKKEIDTTSMEGRVYQSPTKLRKRTETGAVVHQKYYEPNVDATGVELHKDSKFYESWQNFKDNNPYVHKVMDWKLKFDESENPVIRASRALTEKVGDIMGGLFQKTELSETLTEICKIDTTFETKRFLKQCETDIIPNVLEAMTRGDLEILKDWCHEGPFNLFAVPIKEAYKKGYTIESKILDVDNVDLVMGKVMEQGPVLIISFTSQQVMAVRDATGAVVEGDPNKIMRVNYVWVLCRDPSEPDPRAAWRLLDISASSNEQLV

SEQ ID NO: 12658 - protein, 205 aa, Leptinotarsa decemlineata
APSEDPVLNDFKREMLFYRRAQAAVSEAIPKLKGLGLLTKRPDDYFAEMAKTDEHMQKIREHLMKKQEQQKRSERVKQLRQQRKEGKMVQIQTKLQRQEEKKEMLNQVKKVRKGMSKDLDFLDGKKNKSIGRKSMEKRKMKDKKFGFGGKKSGMKSNTKDSAADISEFRNPGKSGKKFPKRNSKHGNKNRPGKNRRGKIKARGKK

SEQ ID NO: 12659 - protein, 276 aa, Leptinotarsa decemlineata
MNETKKLEHVSLVSKICTQLENHIGLNDKDVAEFIIHLSEENNTLESFTKVIKDNDIELSDSFIADLLHIIQDNNGRIAKMSEKAPTTEKMNEVEKLEYLSLVSKVCTELENHLGLNDKDVAEFIIHLSEKNNTLETFTKALVDCGSGFSDSFIANLLRIIQHMKPPKNQSKEEAAITQKEVLAKKFPGLSIPNEPQKPLDLEGNENDSIDTDIVADMMKQFEADAPSKKDNIEKDSSRSKDGKNRNDRKRSTSRHRSSRRSRSRSPKRRRLSPRS

SEQ ID NO: 12660 - protein, 627 aa, Leptinotarsa decemlineata
MNPAAPNYPMASLYVGDLHSDITEAMLFEKFSTTGPVLSIRVCRDLITRRSLGYAYVNFQQPADAERALDTMNFDLIKGRPIRIMWSQRDPSLRKSGVGNVFIKNLDRSIDNKAMYDTFSAFGNILSCKVAQDETGTSKGYGFVHFETEEAANKSIEKVNGMLLNGKKVYVGRFIPRKEREKELGEKAKLFTNVYVKNFGEDLSEDQLRSMFEQYGKITSYKIMSKDDGKSKGFGFVAFENPEAAENAVEALNGKEIIEGKSLYVGRAQKKAERQQELKRRFEALKMERLNRYQGVNLYVKNLDDTIDDERLRKEFSPFGTITSAKVMMEEGRSKGFGFVCFSSPEEATKAVTEMNGRIVGSKPLYVALAQRKEDRKAHLTSQYMQRMANMRMHQMGQFIQPGASSGYFVPTIPTSQRFYGPAQMAQIRTSPRWPAQTPVRPAGQGGTAAYTGMPNTYRAAARPPNQSTAMRGNISVPRPITGQQPQTMQGRPLAGQGVVPATGSRTNFKYTSNMRNPPQALTLQGAAAPVQQAVHIQGQEPLTSTMLASAPPQEQKQMLGERLFPLIQRMYADMAGKITGMLLEIDNTELLHMLEHNESLKNKVEEAVAVLQAHQAKQAATQIKKE

SEQ ID NO: 12661 - protein, 916 aa, Leptinotarsa decemlineata
MTDSKYFTTTKKGEIFELKSELNNDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLYDISSGLVEDQGFLEQLKELLSDSNPMVVANAVAALSEINESSPTGQPLVELSTNTINKLLTALNECTEWGQVFILDSLSNYTPRDDREAQSICERITPRLAHANAAVVLSAVKVLIKMMEILAGDTEFCTTMSKKLAPPLVTLLSSEPEVQYVALRNINLIVQKKPDILKHEMKVFFVKYNDPIYVKLEKLDIMIRLASQVNIAQVLSELKEYATEVDVDFVRKAVRAIGRCAIKVEPSAERCVATLLDLIQTKVNYVVQEAIVVIKDIFRKYPNKYESIISTLCENLDTLDEPEARASMVWIIGEYAERIDNADELLDSFLEGFADENAQVQLQLLTAVVKLFLKRPQHTQGLVQHVLSLATQDSDNPDLRDRGFIYWRLLSTDPAAAKEVVLADKPLISEETDLLEPTLLDELICHISSLASVYHKPPTAFVEGRSAGVRKSLPARQGSNEEVSSAPEATVIPNQESLIGDLLSMDLGAPAPPVSAPAPVPTSNVDLLGGGLDVLLGGPDLSAGAAPSTTGLLGDIFGLTSAPTMYTPPKICWLPADKGKGLEIFGTFSRRTNQISMDMTLTNKAMQAMTGFAIQFNKNSFGITPSAPLNVPALQPGQSLEYSLPLSTTGPVQRMEPLTTLQVAIKNSVDVFYYACQVPIQVLFTEDGTLDKRVFLTTWRDIPSANEVQYTINDIKGTTDGVSNKMTLNNIFTIAKRNVEGQDMLYQSLKLTNNIWVLLELKLQPGITTATLSLKSRSVEVAPYVFQAYDSILKN

SEQ ID NO: 12662 - protein, 163 aa, Leptinotarsa decemlineata
MPPKFDPTEVKYVYLKCVGGEVGATSSLAPKIGPLGLSPKKIGDDIAKNTADWKGLKITVQLKIQNRQATISVVPSAASLIIKALKEPPRDRKKQKNIKHSGNISFDEIISIAKQMRPRSMAKQLSGTVKEVLGTAQSVGCTIDGKPPHDVIDEVNDGTIEVP

SEQ ID NO: 12663 - protein, 364 aa, Leptinotarsa decemlineata
MGEEGKRALILVGGYGTRLRPLTLSRPKPLVEFANKPILLHQIEALVEAGVTEVILAVSYRAEQMEQELTAEAAKLGITVVFSHETEPLGTAGPIALAREHLSKSTKPFFVLNSDVICDFPFRDLARFHEAHGKEGTIVVTKVEEPSKYGVVVYGKDNCIQSFVEKPQEFISNKINAGLYVLNPSVIDRIELRPTSIEKEVFPGMAADKQLFAFDLQGFWMDVGQPKDFLTGMCLYLKHLRSTNGSKLYKGPGVVGNVLVDPSAKIGNDCQIGPNVTIGPGVVVEDGVCIKRSTILRDATIRSNSWLESCIVGWNCSVGRWVRMEGTTVLGEDVIVKDETYINGGQVLPHKNITTSVPEPQIIM

SEQ ID NO: 12664 - protein, 290 aa, Leptinotarsa decemlineata
LNMASDGEDVITDQEKVKIVSDFILHSPPGEFNEVFNDVRKLLNNDDLLKEGASGAFAQYNKDQLTPVKIENSDNLVLITEYNDQGNNRFFDPRSRQSFKYDHLRKEASDYQTYTPDPAAEPWRSALDAEFIQYTRNHYRDGVCSVVGRNQGGNVVLTACIEDHQFQPKNFWNGRWRSQWSISLNGGSVAEVRGVLKVQVHYYEEGNVQLVSTKEIKESVVVTNEAQTAKEIVQVIETAENLYQTAISENYQTMSDTTFKALRRLLPVTRTKIDWNKIVSYSIGKELKTQ

SEQ ID NO: 12665 - protein, 1220 aa, Leptinotarsa decemlineata
NTGPSDTTNPNYAVVPPVVSDSKPAITNSETNDTNNDVVMLSPTKFLMKKGRSGRLLEYPTDYDPMTSHIAPPDSDQRGYSGVPYVLTETRLQQIRQNFMYPYYNRGGNADDEGDYQKEIQSSIPQVYKNLNFQLPFFGFRFNYTRVSLNGYLEFSDPPPNYDYPLVFPVKEWPKKNDPSFIGIFFSKCRIGNLRDGDIDQRDPGVYFRMERDLRNRQDRMGVEIRERLKWDIREGVIGSETFNPKHAIIVTWKNISFNGGFGNALYQTNTFQMILATDEVFTYAMFNYLNLDWTTHTEAGGDTRKGEGGVPAFVGFNAGNGTRSFEYKPYSQESVIRDLTQTGFANGFKGRHIFRIDENILTGTCNKDIDGANLPLMISPESGNMLGGTIVNITGPCFGLDDQVKCKFDVADEINGVVIDKNRAICIQPRLYAEGWVNLQIAIGAGVYKWKGKYYVESPAAASQKIYFKDMKVHEKSPSEIRITWEKYNLTTNENANIRISLWGYRETTIRPTFVYITDIADSLQNTGEYTIVPSQYRTKVNEFLTDIKFGFLQINLTESIKVNTYTSVQRSVEIVPVVWSRPIPLGWYFQFQWENMYGRSWPKALCDDWLRTDRYLKNFAHELPQCPCTVEQALADKGRYMPDFDCDKDSNPVCYYNNQALHCVKTGSPTLEGSEQQCCYDKNGYLMLSYDQQWGSSPRRCHNLGKMPYNEATKVPTLSQWFNDMVPKYLCCLWQEEQAVGCETLRFERRPTQDCVAYQAPGIAGIYGDPHVITFDDVEYTFNGKGEFALVKSVTQTDNLEVQGRFEQMDPNAYGEVRATQLTSIVARGNNTIAVEVRRRPLDARWRYRLDVIADNRKLFFDRPSLKFQHFQGVTIYTPTYILNQSEVIIMFDNGAGVQVMDNQGFMTARVYLPWSFINKTVGLFGNWSFNKEDDFTLPDESKAAVVGNINDMERVYNDFGSKWMVDDVLDPKRGRSLFFREFGRSSATYNNKTFKPQFLMLPEDIIPANRSIQIQRTYDICSTKMYECFYDYAMTLNRDLAHFTQNYKATIYQLKETTRQKVVSCGVLETPRFGRKSTFLFIPGTKVTYECNQDFVLVGDPRRECLADGTWNAPEYGYTECLRQQEYSQRQSAIASGAVLAIIIPLVLLFVYLAYMFLKKKQKERDEENLQTQAYEQQKRQAQEAAARKLTAAEEYNSDEDDNNSNVTSTAKETTVY

SEQ ID NO: 12666 - protein, 99 aa, Leptinotarsa decemlineata
MSSSSDSDSSFFSSFLDSFFSSAAAGAAEAAAAAGAAPPAGMELNFSRPWAMSSSIDFPPSSAMTFFSRSPSASIPTDPKIFSRSAADGEVFPPKTAKR

SEQ ID NO: 12667 - protein, 706 aa, Leptinotarsa decemlineata
MTDRFGLKWDPKNLEIRTMSVEKTLEPLVLQVTTLVNTKGPSKKKKGKSKRANALVSTVEKATENFIEKGEQIAYENPDITDEMLAAVEEVKKTGTAMSVAAREFSEDPCSSLKRGNMVRAARNLLSAVTRLLILADMVDVHLLLKSLHVVEDDLEKLKNASSHGELLDNIKAFGQNANELMNQAAKRQQELKDPQLRDDLAAARAVLKKHSTMLLTASKVYVRHPELAAAKANRDYVLKQVCEAVHTINDVAQGRTPQPACGPYDGPGELAAALDDFDDHMVMEPLAYNEVHTRPSLEERLESIISGAALMADSSCTRDERRERIVAECNAVRQALQDLLSEYMTNMGNKDKSESLNRAIDNMGRKTRDLRRQLRKAVVDHVSDSFLETNVPLLVLIKAAQNGNEKEVEEYAVVFTEHSNKLVEVANLVCSMSNNEDGVKMVRYAAAQIENLCPEVINAARILAARPRSKVAQENMAAFKQSWENHVRILTEAVDDITTIDDFLAVSENHILEDVNKCVLALQEGDADTLDRTASGIRGRSNRVCNVVSAEMDNYEPCIYTKRVLEAVKVLNDQVMPKFTQRVQVAVQALGNNPPKEVDENDFIDASRLVYDGVREIRRAVLMNRADEDLDPEDVELDENYTLENRSKSSAPTEEDPVDEYPDISGITTAREAMGEMLEEDKQKILQQVELLRSEKLKFDCEVAK

SEQ ID NO: 12668 - protein, 366 aa, Leptinotarsa decemlineata
MSFNFGNTPVSKPGATVFALPTNPTTTSATGFQFSAASGDTKNQKPTSSAFTSLTQVKPTGTLGGQGTTAAFPTGGFSFGNTKSATTTTAFVPISGSTPVTKPTTTTGLSLGVPSVTSTAAGITTTSATKLSFGLSSGSSTTTAVVTTSGTSSTIVPAATTVTSSTSIIPATGLLTFSQLEDSINKWTIDLEEQGKFFINQAKQLNAWDSLLISNGEQILNLNGSVERVKQQQQQLDQELDFVLAQQKELEELIAPLEKELWDIPVTDIDRNQMYQFSEMIDSQLKQMSEDLKEIIEHINESNRNEAASNPIAQISRILNAHMNSLQWIDRNTSQISSHLEQITKMQDSNRRNLALSNSFNHSMNM

SEQ ID NO: 12669 - protein, 193 aa, Leptinotarsa decemlineata
MFIWDWFTGVLGYLGLWKKSGKLLFLGLDNAGKTTLLHMLKDDRLAQHLPTLHPTSEELSIGSMRFTTFDLGGHSQARRVWKDYFPAVDAIVFLVDANDRNRFKESKQELDSLLTDETLSNCPVLILGNKIDLPQAASEDELRNYYALYGQTTGKGKVARSDLPGRPLELFMCSILKRQGYGEGFRWLAQYID

SEQ ID NO: 12670 - protein, 213 aa, Leptinotarsa decemlineata
TVRWYRCHSGESGGKEVEILFCICVTLLRVIFLMDPINLLESRIENLEIQIFGDKLPTTNTKNVTSLLLETHAMITSALSCREVISSMLHHLSIINEYLDPNLGVDELEAEAKRYHLLQLYSELKDTVQKIGTLESLLPFIDSENIAKVTELSGNIEQLAVGNMNTYSECQEVTQNVLKSLRNYNEIISTIKILFADLDTEVSLLENSLITEE

SEQ ID NO: 12671 - protein, 579 aa, Leptinotarsa decemlineata
MTTSDVYNDLSLYVTPEKFYLEPRNSDELLIIDRPSEQITIQRNVGQIPASSSRRDFCGLLGTIHLLAGPYLVVALQRDLVGYIAGHAVWRLAKAELVPYNRTLLHLDAEQQNDNNVYLSMVEQMLSTPFHYFSYDYDITHSIQRLHDISPDFWQQSLYERADQRFVWNNHLLQPFKSAGVKRFCLPLLHGFVSINQCVINGHNLSWTIISRRSVLRAGTRLFRRGIDRDGNVANFVETEQIVEFLGDRASFVQIRGSIPLFWHQNPDLRYKPPPTLLDVDPQEQQAACLRHLEEMTAIYGKQVLVNLIDQTGREGGIEKAFRDTISILGFASARYEPFDFHHECRKMRWDRLSILIDRIALDQDEMGFFLILRDGSLSSLQDGVFRTNCIDCLDRTNVVQSMLAHRNLDVVLKKLNILHPNQRLDEQSSFEMLYKNVWADNADFISIQYSGTGALKTDFTRTGKRTQLGLIRDGINSLVRYYKNNLTDGYRQDSIDLFLGYGKIISPLTVEKGWRYMTFPSVLLMAIAMFVASAVFPSEYSTENLLYLLFWGSMVYVSAHTILKYGVEFVDKPRLTQS

SEQ ID NO: 12672 - protein, 549 aa, Leptinotarsa decemlineata
MPPTIQQSGQSTANGVEKRPVKPVEKRSDLICKVKYCNTLPDIPFDLKFISYPFESIRFIQYNPTSLERNYRYEVLTEHDLGVSIDLINKDIYAIEPGAYLDPADEKLLEEDILTPQDSKRSRHHAKSVSWLRRTEYISTEQTRFQPQTMDKVEAKVGYSIKKSLNNETLYMDRDSQIKAIEKTFEDSKIPIEKHYSKPNVVPVDILPVYPDFNLWKYPCAQVIFDSDPAPVGKQVPAQIEEMSQAMIRGVMDESGEQFVAYFLPTEETLQKRREDFANEIPYQDDEEYEYKMAREYNWNVKSKASKGYEENYFFVVRQDGIYYNELETRVRLSKRRQKIGQAPSNTRLIVKHRPMDANEFRMQRYREKQLEPPGEEDEEMEVEETQEETQEETQEGQGNDSQAESDQENREKAGSGKEEGSRASSRSSRKSKSRSRSRSNSSAKSRSRSRSKSASKSRSQSRSRSRSKSKSRSRSVSRSRSRSKSGSKSPSRSRSRSGSKSPSRSRSSSKASSRSRSKSRSRSGSRSRSNSKSPSRSRSGSRSGSDSE

SEQ ID NO: 12673 - protein, 389 aa, Leptinotarsa decemlineata
MPIENLEDQGLEKNPDLELAHYKFLLTLPEYQNDTLVHTKITEAIKKDDMAPWYELICKDSGWKVDQNLLKAMKMKNDEQIKLLDEAIEDAEKNLGEMEVREAYLRKAEYFSRIGDKDNAVSTFRQTYDKTVSLGHRLDIIFHLIRIGLFFMDHDLITRNIEKAKTLIEEGGDWDRRNRLKVYQGAYCMAVRDFKTAANLFIDTVSTFTSYELMDYKAFVRYTVYTSIISLPRNQLRDKVVKGSEILEVLHSEPFVKDYLFSLYNCQYAEFFSNLAEVETTLRKDYFMNPHYRYYVREMKILAYTQLLESYRSLTLQYMAEAFGVSMEYIDQELSTFIAAGRLHCKIDRVGGIVETNRPDLKNAQFNSVVKQGDLLLNRVQKLSRVINI

SEQ ID NO: 12674 - protein, 150 aa, Leptinotarsa decemlineata
AFSEPPSPWVSASDPPEIDSTNVGVPSTYNQRSSEKMKADEGLGKGATISAVLYANVNHPEWKKEFPSWSDRYKQIIKKWRTLSQDQKAPFLQLARDNRSQLRMKKSQQDQDKMALQQKSAREAEQERQWKQLQALRQQQAQQQQHVIHE

SEQ ID NO: 12675 - protein, 1434 aa, Leptinotarsa decemlineata
MEDSSEERRPKRSKRETSYKAKAFEKFKQLKSGIRNKYEVEELDSVYEVVEEKEYVKKVLSRQDDDWIVDDDGSGYLEDGRDIFDDDLDSESIAQASARGKGVKRKKKNVSENAGRGNLQQMLSSMPTKKKEETKLDDDEMLSEILGEIDETSASIPKPKIKEYSVMSRKLAAKNYMKNLSVPNKNISITRPISDILKKEATGNILKEVQNKVIENGDLNEIAEFPQVDIVEENSLRITEEEEQPVELSENLTIEDDFTQECFEDDIDMTQIEEFESQQLPDISVDEEKISDELQAEFMSEWENFTNESDDIDMDKLVDRSDIPLVEVDNKKVFRFYWWDAYEDPEKQRGVVFLFGKTYCDKTKSFVSCCVAVRNISRRVFLLPRPFELGEDGTPTEEPVTFKKMYNELNEKIIKPLHISFFKTRSIKKKYAFNPEIPTESEYMELRYPATDARIDLGDLKKKPQTISKIFGTNSSFLEILLLERKVKGPCWLDISNPSPVSNPLSWCKFEVNCIKVTDLNIMESDKPLPPPPLVVAAINMRSFVNPKTYANEILMMSCLTQTKYAVDKKPPNPPFQQHFCVFSCPAQQVLPLNIHEALGNYRVTKVQKMDSERALLNYFITQFSKIDPDLIVGHDLQGYQINILADRLTKQDNKTFSKLGRIKRSEKKRLEKHLFAGRLVCDIKISAKELIKSRSYDLDALCQVILKLKENQRIELEPEDIPKMYQSTKDLLKLISFTVQDTSYILKMMYDLNVIPLALQITNIAGNIMSRTLMGGRSERNEFLLLHAFSEKNYIVPDKEYKRKDTTLSSSARKKPTYSGGLVLEPKIGFYDKLILLMDFNSLYPSIIQEYNICFTTLPVTNSEDNLVLPDRGLPPGILPTEIRKLVESRRQVKKLMNSADISLDLKMQYNIRQIALKLTANSMYGCLGFSNSRFYAKNLAALVTHKGREILTNTRDMVEKMCYEVVYGDTDSIMINTNILEYDQVFKIGTKIKQEVNKLYKQVELDIDGVFKYLLLLKKKKYAAVTLTKINDNKLKEVKEYKGLDIVRRDWSQLACGAGEYILDHILSDQSPDDRINNIHEYLRKIRKHMEEGQVPISLLVITKQLTKDPKMYTDKNSLPHVQVALRYNQQSGGHFRAGDTVPYVICEDGTSNSASQRAYHIEELNKSETLKIDVKYYLGQQIHPVVTRICEPIEGTDSFQIAECLGLDTNSFKKPKQHSMEVIGQNISKPEVKFRNVDKFKFKCYICKQENVVDNLLDGNIRFLEKCKNSECGVRPVEYLPYIQNQLALAIQLYITKYYDNELTCEDPACTNETNRLPLKFFKKYPVCTLCQKGVMYRTYTEQQLYTQLTYFQHIFDLGKLNKGLDPDLESGYHSLRETVEKYLNHSGYSVINLTELFSGFLVRNKHPNTIERIDVPYEELENFDEEDEEF

SEQ ID NO: 12676 - protein, 465 aa, Leptinotarsa decemlineata
MAAAAAAKIVEVRESTKVERIGAHSHIRGLGLDDSLEARHVSQGMVGQVSARRAIGVVLQMVREGRIAGRAVLLAGQPGTGKTAIATALAAALGVDTPFTSMAGSEIYSLEMSKTEAITQAIRKSIGVRIKEESEIIEGEVVEVQIERPATGVGTKVGKLILKTTDMETVYDLGGKMIDSILKEKVQSGDVITIDKATGKITRLGRSFARARDYDATGQQTRFVQCPEGELQKRKEVVHTVTLHEIDVINSRTHGFLALFSGDTGEIKAEVREQINGKVAEWREEGKAEIIPGVLFIDEVHMLDIECFSFLNRALENEMSPIVMMATNRGITKIRGTTYKSPHGIPLDLLDRTIIVPTQPYEEKELKEILSIRCEEEDCQMSDTALAVLTRICKETSLRYGMQLIMTSSLIARKRKAHEVDVQDIKRAYELFFDEGRSVQFLREYQQEFMFNDLDDKDDMEIETN

SEQ ID NO: 12677 - protein, 371 aa, Leptinotarsa decemlineata
MALRTYGDKPISFQLEENGEYYCVGSEVGNYVRLFRGSLYKKYPGMFRRSITNEERRRLIDLGLSQHVLASSVSLLKATEVEDIIEGNDEKYKAVSVHTSEPPAPRESKSKKNMQWVPSLPNSSHLDAVPQATPINRNRVASKKVRTFPLCFDDTDPQINVENACQGEVLVPIRLDMEIEGQKLRDTFTWNKNESLITPEQFAEVLCDDLDLNPLTFVPAIAQAIRQQLEAFPAEPSSIIEETCDQRVIIKLNIHVGNTSLVDQIEWDMSEKQNNAEEFALKLCAELGLGGEFVTAIAYSIRGQLSWHQRTYAFSEAPLPTVEVPFRTPSESDQWAPFLETLTDAEMEKKIRDQDRNTRRIRRLANTTPGW

SEQ ID NO: 12678 - protein, 207 aa, Leptinotarsa decemlineata
MFCCCSDQEDYGKGPMAAIRKKLVIVGDGACGKTCLLIVFSKDQFPEVYVPTVFENYVADIEVDGKQVELALWDTAGQEDYDRLRPLSYPDTDVILMCFSVDSPDSLENIPEKWTPEVKHFCPNVPIILVGNKKDLRNDPSTINELKKMKQEPVKPQDGRSMAEKINAFAYLECSAKSKEGVREVFENATRAALQVKKKKKHRCVIF

SEQ ID NO: 12679 - protein, 1337 aa, Leptinotarsa decemlineata
MNTSTFHNQRADTSQNPLNRMEHASRNVEKSLQLDCNAPKLVDLMGIGPQTGSTASGLIDHDYPTLSALPLVNNNMTQIKCVNSVPLPSEIVDHFTHVQCHCMMGLFSEINRAWLTVDSDIYVWTYEENTDLAYFDGINETILCVGLVTPKNRVFHAFIKHLLILATSVDIVVLGVTFTEKPGESTDEIQLIPDPVFTIPTDGSTVSIITGTEDGRIFFGTKEGCLFEISYQAESGWFGKRCKKVNLSTSSFSFLVPSFLNAALSEDDGITQISIDNSRHILYTLTEKGTIEVCDLGEKGNSFSRIAKMTQNTLVNQAMNTVKTLDSQNFRPIISISAIESFESANLNLVAVSQTGIRFYMSVVSLSNFLPNQRPYTLTLVHVRMPPGYSANVTVRPRAVHVSQYRDRNSLLISTVNEKDVLWCISSDLFPFSQTLMEAYTTVNLDGPALAVAEVHQSVPLLSTQNEEAPPLVIRQHAEPPKKFIVLTSHGVQIFVKLRPVDLLRQILKDSRGQETEALKTFFAIQKDDQACATCLILASLETSNTSEIVEYATRAFFLFGGEPKLAPVSSGNMFSGASIFSPNIISTPAPHQFQQQQQQFQQNLSLTMSPANQTLDMICPFIFSAKHNGLYLYLSRILRPIWYRRCIERTTVDGKTITNLSTISSEDCISILTNLTALHNFLMHNTQLSAVSTGSCNLQNSVSLNNTSMNMTRMNQTIQDAQQEEKQSLKSLKVFVCHCCQILGLWQILCEHQFHSLIGALPENEQQLLQNMAFKDLFLYRQDICSLLITNLVDSYLGDNASVDSISNKLREVCPHLYKTEDAAFSKAIEILKAARTIQNADEKEEMLLSALQICKCISPNINMGEVCREFTSLKAYRAVIELCMHYGRMMDPEKVAENYYNTDDNSADQEGFNFYQRRMEIYKHILQMLEYVYNEQQQVPNNRCEPDYTTNQSILLNDTRESQIGCTLKQVIEEILETPDEIMQVALYEWLVSKNMSGDLIKIHNSSLEVYLKKTSAQNPNNISVMDLLWKYYESNNNHAAAAKVLNNIACKTGNYVPLKERLSYLAKAIMCMRSDKVGYAPYLGVFLRDLEDRMEVAKVQEQIQEAISNLQGQVPNVQEAVAALNSGLYEISQLYENFAEPFKLLECQLAIIDCSGYSDKVLVESIWQQILADELRKASGSVNDKLSQVLAKVKHLAKQYSKSVYTFPLDSVIFELESVNSKLKGDKRLVPEALESVNIPFEVLINAYNNLNQMSHNDRFWQLEEHEFHLAEATAALIDCFLNKSDCYNSIEKRKLASMCQDTVVGLLSHLYSKPNTDHLVNRIRGIQARLSRI

SEQ ID NO: 12680 - protein, 1281 aa, Leptinotarsa decemlineata
MTEFTLNYREITPDQTVSDNWKEITLTTGGTQSTLQDIKVAERANGFCYEDSTKHHTRNRFIYWRINYDILELVEHSLDVNLTANRVRYRFTDTPILDGVSIYETYENVIVLVPTVCSVHRLIFPHPERFHRQDELLGAYTDLSVPSIFSKASAIDARNPSTFYVFSNPSTASDQLPNLASSYLFPETEEAFFVLAYPSTELLLIKQNPDDGQVVATELKGESLMPRFLSGLAEKFRQKNSDGSNIVSLLFYVVDYETYVLTLSRDGHLKFWSCAKGQCVAVVDILEKSGEVSRTRIQSASLRKAVDGNSSESLLAVFLSFANGCQFQILSPVIRGQEITVDRLDTRHSPESDLIDFALQTNRLWTAWRCEDGECVVYTTSLQPGMSQSSRHSGLLQSSNWAPVVLETIPDANQAPVNDGESDPRQIYLQHIFHPGRFPMHIITKALSIYKRSTLVAETHISASILKQRICLAVDNEIQNTLNGTNVTDDEYLECAEWCWQKFYSCCVQYQIASLKPLGLMLLPSVSGAVFLKKSSFSFLRPLDPLEHMTLCNDSTYSDQFVNFSMLAEDVETTDDVMRLFEVLVYLEQQMSEMFIQAFEKELFTLQVPDIVMENILEKIQSEMDCQFTSHILNMLNNIVDLYRAMHKVLELLRYENTLANPDNEINPSAMFHFSSQLGTSVVAGCLKQQAEIRFQICRNLLLVCNILLSGKAFDSGVLEAIRSVCMPEIVVLTQASYVMLWLSGLSALGNLPQDSGMQKLTPLKLAPVFNLRPAGIFISLLELFISSTGGQEARKSFARVNCRGEDLAHWHLSLLPFLNHLRHIIWPISGGTVLAEWLLSSGQHLWLQQYVRLLGNWCEWNSCTRNFLLAASFLTTGENYKAQELFERAAKGIFTDTFLQERVLKGAEDNPTKAYINYYLKVIQLFELHKARDCAISIANTALSVVEPTDPLTATLYSIKFKHQLALKHYELAFDSLYSNPDAERKKDNLRDLVKTLLDEKKLDKLLNFTYGNLDEFFTNILLSRARASDGINNIFYDFLYSYQIKRGALSHRLAASVMYEQAFRLNHINTAESLEKQVKCYLAAKNVLQLCKPEHAWVVRPSDPDEEEEEIIIQPLAGSKQELKVVKLQKQVEVVNIEVIKTELIFASAKLKLARFNSAAPVTITSAVELVTLLNNAGLFKTSLEICKTFNLPYSSVFETLTKHCVNLTEQDQPTAWNWLVENDLQDLPVNRDSASDVVWQLLQDYLEKYEQPYMTTLHYVVCKKIINMRMYIPHWLLA

SEQ ID NO: 12681 - protein, 705 aa, Leptinotarsa decemlineata
MEISEENLKTLAKYLQETLNPDINVRRPAEKFLEGVEVNQNYPVILLNVVNKSDVDMTIRIAGAVAFKNYIKRNWELEENQADRIHESDRAEIKNSIVTLMLSSPEMIQKQLSEAISIIGKIDFRMEWPNLIPQMVEMFATGNFNVINGVLRTAHSLFKKYRYEFKSQKLWMEIKYVLEKIAQPLTDLFIATINLSQTHANDVNALKVIYSSLVLICKVFYSLNFQDLPEFFEDNIQVWMSNFHTLLTVEVKSLQNNNSEEAGVIEQLKSQVCDNIALYAQKYDEEFQPFLQQFVTDTWSLLVGTGLEPKYDLIVSNALQFLSSVAERAKYRSLFEDDTVLSSICEKVIIPNMEFRVSDEELFEDNPEEYTRRDIEGSDVDTRRRAVCDLVNTLSQNFEKRIIEIFGQYLHVMLTKYAENPKQFWRSKDSALYLVTSLASRGSTQKHGVTQTSQLVNITQFCQQQVLPELERPDVNELPVLKADAIKYVMTFRTILPNEIVVSTLPQLIRHMSSESAVVHTYAACALEKILIMKNNNNQPIVSGMQLETISNDLFSNLFAILERPVSEQNEYVMKAIMRTFATLQERVIPFLNMSLPKLTEKLQMVAKNPSKPHFNHYLFETFSLAIRIVCKANQSAVTSFEDILFPIFQGILQQDIQEFIPYVFQILSLLMENTPTGSIPEPYMQLLPCLLAPILWERPANINP

SEQ ID NO: 12682 - protein, 202 aa, Leptinotarsa decemlineata
MAKVQLCNITVMDNPSQFLNPFQFEITFECIEELKEDLEWKMIYVGSAESEEYDQVLDSVFVGPIPEGKHMFVFQADPPNVSRIPENDAIGVTVVLLTCSYRSQEFIRVGYFINNEYSDPELRENLPSPPQFDKVVRNILASEPRVTRFKINWEETNPQENVTHTEQTATGSSVNVENNSSTPADVPSFNENSNSWATMECS

SEQ ID NO: 12683 - protein, 308 aa, Leptinotarsa decemlineata
MDQMLPSPGFSIPSIGTPLHQPEEDQMILPNALQQQQQPSTSQVPPLAPMGGLTPTLGLGMGHAMSMTPTKYVTGFALPMSTITQQTPQHTMMSPLVNLGGSVVTGSTPTMAPATPSPLTPMTPHSADPGIIPQLQNIVSTVNLNCKLDLKKIALHARNAEYNPKRFAAVIMRIREPRTTALIFSSGKMVCTGAKSEEDSRLAARKYARIIQKLGFNAKFLDFKIQNMVGSCDVKFPIRLEGLVLTHSSFSSYEPELFPGLIYRMVKPRIVLLIFVSGKVVLTGAKVRQEIYEAFDNIYPILKSFKKQ

SEQ ID NO: 12684 - protein, 157 aa, Leptinotarsa decemlineata
MAAVRSVSRLFSLRSLTTTAKRSYADMSFTFAAGNQVYYDAKSVKQVDVPSFSGSFGILPAHVPTLAVLKPGVVTVYEEGGNVNKIFVSSGTVTINEDSSVQILAEEAHPVGNLDASAAREVLSKAQSELSSATTDEARAEAAIAVEVGEALVKAVE

SEQ ID NO: 12685 - protein, 323 aa, Leptinotarsa decemlineata
MSGSGDKTEHFDSMFLSIAQHHPEGASQLLDTFVSFLGRKTDFFTGGKEGEWEKLVMNTFRKHEKQSREKQEAELKEKREREARAKAAAAKKAEAERVEPAKITELTDAEAEQLQAEINAKKNPSSSSSQPAAPIGDKIKEDEDESEKGKILPNKGNGCDLDKYKWTQTLGDIELRVPLNVNFRVKQKDLVVNLTKKHLTCGIKGQPPIINDDFPYEIKLEESTWVIEDGKSLLFNLEKVNKMNWWNKLVNSDPEISTKKINPEPSKLSDLDGETRGLVEKMMYDQRQKEMGLPTSDEQKKQDVIKKFMEQHPEMDFSKCKFN

SEQ ID NO: 12686 - protein, 157 aa, Leptinotarsa decemlineata
MQSHSGAHLGHVPVLQWSPDKKHSDRERWICIYPAYINNKKTLAQGRKINKDKCVENPTHQEIRDVLVAANLKIGVENKLYSREKSKEPLYRGRIRVQLRNDDGSLFNSAFPTRESIMYHLGEMIPKLKSRQNKGAGEAPQQASTSNKGKGKGKGRR

SEQ ID NO: 12687 - protein, 355 aa, Leptinotarsa decemlineata
EESQKDIQRARSVWERALDVDHQRVPIWLKYTEMEMRNRQVNHARNLWDRAVTILPRIDTFWYKYTYMEEMLENVPGARAVFERWMEWQPDEQAWQTYINFELRYKEIDRARQIYERFVMTHPEVKHWIKYAKFEEKHGFIHSARKIFERAVNFFGDDHLDENLYIAFAKFEENQKEHERARVIYKYALDHIPKDQTKELYKSYTIHEKKYGDKSDIDEVIESKRKFQYEQEILQNPTNYDAWFDYIRLVEGEGDLEFIRETYERAIANIPPSNQKQFWRRYIYLWINYALFEELEAKDYDRTRQVYKACLELLPHKVFTFSKIWLLFAKFEIRQKKFNSCQKNSWNGFGNVSEG

SEQ ID NO: 12688 - protein, 310 aa, Leptinotarsa decemlineata
MGIKFLEVIKPFCSILPEIAKPERKIQFREKVLWTAITLFIFLVCCQIPLFGIMSSDSADPFYWIRVILASNRGTLMELGISPIVTSGLIMQLLAGAKIIEVGDTPKDRALFNGAQKLFGMVITVGQAIVYVMTGMYGDPAEIGAGVCLLIIIQLFVAGLIVLLLDELLQKGYGLGSGISLFIATNICETIIWKAFSPATVNTGRGTEFEGAVIALFHLLTTRQDKIRGLREAFYRQNLPNLMNLLATVFVFAIVIYFQGFRVDLPIKSARYRGQYSSYPIKLFYTSNIPIILQSALVSNLYVISQMLAV

SEQ ID NO: 12689 - protein, 161 aa, Leptinotarsa decemlineata
MAMITTPSVDLSSYRDQHFKGTRAEQDKLLRVTSTLYVGNLSFYTTEEQIYELFSKCGDIRRIVMGLDKYKKTPCGFCFVEYYTRIDAENCLRYINGTRLDDRIVRTDWDAGFIEGRQYGRGKTGGQVRDEYRTDFDSGRGGYGKIIQQKIGGIETPAFLR

SEQ ID NO: 12690 - protein, 143 aa, Leptinotarsa decemlineata
EAARAANNGAYPPDLSYITSARHGGEDYIFALLTGYCDPPAGVVLREGQYFNPYFPGGAISMAQALYNEAIEYSDGTPATASQLAKDISTFLKWTAEPEHDDRKKMLIKCIGIFAMLAGLCYYMKRLKFSSLKTRKIEFRPKK

SEQ ID NO: 12691 - protein, 569 aa, Leptinotarsa decemlineata
MLALQQYSGSSDEDCGEDTHSSNVEVFPTIPKNSQLLQKQLAICSAPDVIPTGLNEENIYIHPETTELTFNPKYEELFAPLVGPKNPFKTQQQSIDRNILSGHVEPAHVSDFQFENQRRTFTSYGYALDPSVSTDGQVKVVGSTDDGKNPDDIKTVFESSKDRPLDKRKRKRNADPSDIDGFLGPWGGFVDEQKIAKPSEEEQAELDELISKKNKRGKPTEDKPVEEKSVLHIKDAVDYQGRSFLHAPQDVGVNLKSDTPPEKCFLPKSHIHTWSGHSKGIAAIRWFPRTAHLFLSASMDCRIKLWEVYNERRCVRTYYGHRQAVRDINFNNSGKHFLSAGYDRYIKLWDTETGQVLSRFTSRKIPYCVKFNPDKNKQHLFVAGTSDKKIICWDTRSGDIVQEYDRHLGAVNSITFVDENRRFVTTSDDKSLRVWEWDIPVDMKYIADPTMHSMPAVTPAPNGKWLACQSMDNKIVIFSAMNRFKINRKKTFTGHMVAGYACSLDFSPDMSYLVSGDADGKCYIWDWKTTKLYKKWKAHDNVCISALWHPHESSKLITAGWDGLIKYWD

SEQ ID NO: 12692 - protein, 268 aa, Leptinotarsa decemlineata
MVQKKPKKKVGKKVAAAPLAVKKVESKKEVNPLFEKRVRNFGIGQDIQPPRDLSRFVKWPKYIRIQRQKAVLQKRLKVPPPINQFTQTVDKQTATQLFKLLEKYRPETALQKRNRLKAKAEAKVAKKEEAPTKRPNTLRAGTNTVTKLIEQKKAQLVVIAHDVDPIELVLFLPALCRKMGVPYCIVKGKARLGLLVRRKTCTAVALTQVDSGDRSNFNKVVEVIKTNFNDRSDEIRRHWGGGLLGSKSAARIAKIERARAKELAQKQG

SEQ ID NO: 12693 - protein, 333 aa, Leptinotarsa decemlineata
MTTLTKDITLQENIPSNILMEKHIEFIRDYGQKENSYEYGMTDYLRVSGMYWGLTALELMNTSPPQSKDEIAKYIKSCQDPESGGISACQKHDPHILHTLSAVQILCIYDNLDAVDIEAVVSYVASLQLPDGSFMGDKWGEVDTRFSFCAVAILSLLNKMDVIDVNKAVDFIASCRNFDGGFGSRPLSESHAGLIYCCVGFLSITNRLDIVNRDTLAWWLCERQLPSGGLNGRPEKLPDVCYSWWVLSTLTILGRLHWIDASALKNFILACQDSETGGFADRPGDIADPFHTLFGLAAMSLLGHESVQKVNPTYCMPQNVIDRLQLKPQRLTD

SEQ ID NO: 12694 - protein, 782 aa, Leptinotarsa decemlineata
MHQETLQLIQILEKTVSPDKTELEQASSFLEQAAATNLLEFIKTLSDILRHGGNSPVARMAAGLQLKNQLTSKDPSVKTTYQHRWLAFPEEIRNYIKKNVVGALGTETNRPSSAAQCVAYIAVTELPQRQWPDLIANLVSNVCQGNSTEMQKEATLEAIGYICQEIDSDVLVTQSNDILTAIVHGMRATEPSNHVRLAATQALLNSLEFTKANFDQPTERNYIMEVVCEATQSPESQIKVAALQCLVKIMSLYYQHMEPYMAPALFPITLEAMKSENDAVALQGIEFWSNVSDEEVDLAIEDSEATEAGRPPARVSRHYAKGALQYIVPILLQKLTKQEELDDEDDWNPSKAAGVCLMLLATCCEDEIVPHVLPFIKDNIKSDNWRFRDASLMAFGSILGGLESTTLKPLVEQAMPTLIELMYDNSVIVRDTAAWTFGRICEIIPEAAINETYLKPLLESLITGLKAEPRVAANVCWAFSGLVEAAYDNADVSDEMGTPDTYILSQYFEFIIQRLLETTDRPDGAQANLRPAAYEALMEMVKNSPKDCYVTVQKTTMVILERLQQVLQMETHISSHNDRSQFNDLQSLLCGTLQSVLRKVTPEDAPQISDAIMTAMLTMFNSNSCKNGGVQEDALMAVSTLVEVLGEGFIKYMDAFKPFLYLGLKNHQEYQVCGTAVGLTGDIFRALKLKVLPYCDEIMTLLLENLGDQSVHRSVKPQILSVFGDMVLSIGPEFKKYLDVVLSTLAQASQAHVDRNDFDMIDYLNDLREGVLDAYTGIIQGL

SEQ ID NO: 12695 - protein, 500 aa, Leptinotarsa decemlineata
METILEQQRRYHEEKERLIDAMVKEMLTKKTMYREAINSDHRQKFLLDRYMTATDRLIELYEDKDGQRKAEVASLTGPNEFQEFYNRLKQIKDFYRRHPNEISVPMSVEFDEFAKARENPNDDMANFVEFTDEEGYGKYLDLHECYEKYINLKGIEKVDYITYLGMFDQLYDIPKERKSGEYRKYLLCLIEYLMWFVQRIKPLMDLESGLQEEVDRVIATWESGTVPGWPKETGSALANVGAHLDLSAFSSWEELASLGLDRLKSALMALGLKCGGTLEERAQRLFSTKGKGSLDPSLMTKTNKGKASKEKEQLRQRELATLEAQVYRLAELVAVQRTATKENVQRKQARTDGERDDSENEESDDDSPDEGDDDVPYNPKNLPLGWDGKPIPYWLYKLHGLNISYNCEICGNYVYKGPKAFQRHFAEWRHAHGMRCLGIPNTAHFANVTQIEDALALWEKLKVQKQSERWQPETEEEYEDSQGNVVNRKTYEDLKRQGLL

SEQ ID NO: 12696 - protein, 213 aa, Leptinotarsa decemlineata
MTIGKNNKMMAHLNYRVRVTLQDSRTFIGTFKAFDKHMNMILGDCEEFRKIKPKNSKVEREEKRVLGFVLVRGESIVSLTVEGPPPPEEGLPRVPIPGAAPGPGIGRASGRGMPPGMGGVPVGLQGPVRGVGGPSQQVMTPGGRGQVSAPPQMNQGPPRMGGPPPGVMGPPPGMMGMPPQMGMGRGGPPPPMGMRGPPPGMMRGGPPGPPRPY

SEQ ID NO: 12697 - protein, 352 aa, Leptinotarsa decemlineata
MMSDADFTNYFRMNRNQFFDVHGMIQQDIDSNGCNAQKPISTEEKLAVFLRYLASGDSYKSIAYNYLLGDRTVSNIVQEVATAIWNNMQPVYLAEPKTETWKSIALRFEDRWQFPHCVGAVDGKHIVIKKPGKSGSSYFNYKHTFSIILMATVDADYKFITIDIGAMGRFSDGNVFASSGLGKKMIKHTILLPNPEQIPTIAEPLPYVFVGDEAFPLSENLMRPYPRRQITGNYQHQVFNARLSRARQTVECAFGILSSRFRVFRRPFESKVDTVRDVVKAACVLHNYLRPSALVEDVNDIEQLPQTQLLHVQGNRARTSLAAFRVRDSFTEYFNNCGALPWQHQSVMLGKY

SEQ ID NO: 12698 - protein, 407 aa, Leptinotarsa decemlineata
TSDDEFIMQGKTKKYNLVPHTGELLNMHGAPESPDQEEMTAEPSPEAIDEEGLNNYDGSELLIIDQNNKSPEDSISTKEDFEELIDEGSRKNNLSKREITTKHLNDFHKYANIFNYTKNVQTIQTPPQNTGRVTNVPQKMTPKISLIGNSVVHSAKTVADKLILTPSATTVINTTQASKVTSIILTHNSAVRGNVINVTKVVSTVSPAITIVTASTSQIASILPSKFTVPVISASAVRHLSNVKVIDKPSSSLSLTSHDSALPNKIFEDDSVSPDSSNFEDDKSKDSFEEKSKSESPTQDAKPPVFSKNVEVTINNCVPPKAVIDYKPKEQEQTKKIEHLQVTNLVSKEHVQKHRVPSPIISKTSSPMIIHNTPELKMTAQVIQETQTHMQMSSTTNTVDAYGGSID
